US010179817B2

(12) United States Patent
Sagert et al.

(10) Patent No.: US 10,179,817 B2
(45) Date of Patent: Jan. 15, 2019

(54) ANTI-CD71 ANTIBODIES, ACTIVATABLE ANTI-CD71 ANTIBODIES, AND METHODS OF USE THEREOF

(71) Applicant: CytomX Therapeutics, Inc., South San Francisco, CA (US)

(72) Inventors: Jason Gary Sagert, San Mateo, CA (US); Kimberly Ann Tipton, San Francisco, CA (US); Jonathan Alexander Terrett, Cupertino, CA (US); Shweta Singh, Fremont, CA (US); Annie Yang Weaver, San Mateo, CA (US); Luc Roland Desnoyers, San Francisco, CA (US)

(73) Assignee: CytomX Therapeutics, Inc., South San Francisco, CA (US)

(*) Notice: Subject to any disclaimer, the term of this patent is extended or adjusted under 35 U.S.C. 154(b) by 0 days.

(21) Appl. No.: 15/146,294

(22) Filed: May 4, 2016

(65) Prior Publication Data
US 2016/0355599 A1 Dec. 8, 2016

Related U.S. Application Data

(60) Provisional application No. 62/315,276, filed on Mar. 30, 2016, provisional application No. 62/310,553, filed on Mar. 18, 2016, provisional application No. 62/277,775, filed on Jan. 12, 2016, provisional application No. 62/257,484, filed on Nov. 19, 2015, provisional application No. 62/257,321, filed on Nov. 19, 2015, provisional application No. 62/156,838, filed on May 4, 2015.

(51) Int. Cl.
*C07K 16/28* (2006.01)
*C07K 16/30* (2006.01)
*A61K 39/395* (2006.01)
*A61K 49/00* (2006.01)
*A61K 47/68* (2017.01)
*A61K 39/00* (2006.01)

(52) U.S. Cl.
CPC ...... *C07K 16/2881* (2013.01); *A61K 39/3955* (2013.01); *A61K 47/6803* (2017.08); *A61K 47/6849* (2017.08); *A61K 47/6851* (2017.08); *A61K 49/0032* (2013.01); *A61K 49/0058* (2013.01); *C07K 16/30* (2013.01); *A61K 2039/505* (2013.01); *C07K 2317/24* (2013.01); *C07K 2317/33* (2013.01); *C07K 2317/55* (2013.01); *C07K 2317/56* (2013.01); *C07K 2317/73* (2013.01); *C07K 2317/76* (2013.01); *C07K 2317/92* (2013.01); *C07K 2317/94* (2013.01); *C07K 2319/00* (2013.01); *C07K 2319/50* (2013.01)

(58) Field of Classification Search
CPC ................. C07K 16/2881; A61K 47/6851
See application file for complete search history.

(56) References Cited

U.S. PATENT DOCUMENTS

| 3,773,919 | A |   | 11/1973 | Boswell et al. |
|---|---|---|---|---|
| 4,434,156 | A |   | 2/1984 | Trowbridge |
| 4,485,045 | A |   | 11/1984 | Regen |
| 4,522,811 | A |   | 6/1985 | Eppstein et al. |
| 4,544,545 | A |   | 10/1985 | Ryan et al. |
| 5,013,556 | A |   | 5/1991 | Woodle et al. |
| 5,030,719 | A |   | 7/1991 | Umemoto et al. |
| 5,151,510 | A |   | 9/1992 | Stec et al. |
| 5,648,469 | A |   | 7/1997 | Trowbridge et al. |
| 6,015,555 | A | * | 1/2000 | Friden ............... C07K 16/2881 424/133.1 |
| 7,465,790 | B2 |   | 12/2008 | Waldmann et al. |
| 7,572,895 | B2 |   | 8/2009 | Mather et al. |
| 7,666,817 | B2 |   | 2/2010 | Daugherty et al. |
| 7,736,647 | B2 |   | 6/2010 | Boumsell et al. |
| 8,129,503 | B2 |   | 3/2012 | de Wildt et al. |
| 8,563,269 | B2 |   | 10/2013 | Stagliano et al. |
| 8,663,598 | B2 |   | 3/2014 | Yang et al. |
| 8,809,504 | B2 |   | 8/2014 | Lauermann |
| 2004/0109855 | A1 |   | 6/2004 | Waldmann et al. |
| 2012/0282176 | A1 |   | 11/2012 | Bohrmann et al. |
| 2013/0045206 | A1 |   | 2/2013 | Poul et al. |
| 2013/0177579 | A1 |   | 7/2013 | Lin et al. |
| 2013/0216476 | A1 |   | 8/2013 | Boumsell |
| 2014/0114054 | A1 |   | 4/2014 | Kurosawa et al. |
| 2014/0212423 | A1 |   | 7/2014 | Hanzatian et al. |
| 2015/0291697 | A1 |   | 10/2015 | Kurosawa et al. |

FOREIGN PATENT DOCUMENTS

| CN | 101245107 B | 8/2008 |
|---|---|---|
| EP | 1 523 503 B1 | 4/2009 |
| WO | WO 94/11026 A2 | 5/1994 |
| WO | WO 2001/91798 A2 | 12/2001 |
| WO | WO 2002/030460 A2 | 4/2002 |

(Continued)

OTHER PUBLICATIONS

Daniels et al., Biochem Biophys Acta 1820:281-317 (Year: 2012).*
Crepin et al., Cancer Res. 70(13):5497-506 (Year: 2010).*
Almagro & Fransson, Frontiers in Bioscience 13:1619-33 (Year: 2008).*
Desnoyers et al., Sci Transl Med 5, 207ra144207ra144; DOI: 10.1126/scitranslmed.3006682 (Year: 2013).*
Friden et al., Characterization, Receptor Mapping and Blood-Brain Barrier Transcytosis of Antibodies to the Human Transferrin Receptor, Journal of Pharmacology and Experimental Therapeutics, vol. 278(3) 1491-1498 (1996).

(Continued)

*Primary Examiner* — Jessica H Roark
(74) *Attorney, Agent, or Firm* — Cooley LLP

(57) ABSTRACT

The invention relates generally to antibodies that bind CD71, activatable antibodies that specifically bind to CD71 and methods of making and using these anti-CD71 antibodies and anti-CD71 activatable antibodies in a variety of therapeutic, diagnostic and prophylactic indications.

58 Claims, 55 Drawing Sheets
Specification includes a Sequence Listing.

(56) References Cited

FOREIGN PATENT DOCUMENTS

| WO | WO 2004/009638 A1 | 1/2004 |
|---|---|---|
| WO | WO 2005/111082 | 11/2005 |
| WO | WO 2007/105027 A1 | 9/2007 |
| WO | WO 2009/025846 A2 | 2/2009 |
| WO | WO 2010/081173 A2 | 7/2010 |
| WO | WO 2010/129609 A2 | 11/2010 |
| WO | WO 2013/192546 A1 | 12/2013 |
| WO | WO 2014/020140 A1 | 2/2014 |
| WO | WO 2014/026136 A2 | 2/2014 |
| WO | WO 2014/144060 A1 | 9/2014 |
| WO | WO 2014/189973 A2 | 11/2014 |
| WO | WO 2015/101588 A1 | 7/2015 |

OTHER PUBLICATIONS

Irving, "Probodies Empower a New Generation of Antibody Immunotherapies," presented at Keystone Symposia on Molecular and Cellular Biology, Feb. 2015.

Baldrick P. "Pharmaceutical excipient development: the need for preclinical guidance." Regul. Toxicol Pharmacol., 2000, vol. 32, p. 210-218.

Boulware et al. "Evolutionary optimization of peptide substrates for proteases that exhibit rapid hydrolysis kinetics", Biotechnol Bioengineering, 2010, vol. 106, No. 3, p. 339-346.

Bowie et al. "A Method to Identify Protein Sequences That Fold into a Known Three-Dimensional Stucture", 1991, Science, vol. 253, p. 164-171.

Charman WN "Lipids, lipophilic drugs, and oral drug delivery—some emerging concepts." Journal of Pharmaceutical Sciences, 2000, vol. 89, No. 8, p. 967-978.

Chothia & Lesk "Canonical Structures for the Hypervariable Regions of Immunoglobulins", J. Mol. Biol., 1987, vol. 196, p. 901-917.

Chothia et al. "Conformations of immunoglobulin hypervariable regions", Nature, 1989, vol. 342, p. 878-883.

Davies et al. "Antibody-Antigen Complexes", Annual Rev Biochem, 1990, vol. 59, p. 439-473.

Eppstein et al., "Biological activity of liposome-encapsulated murine interferon y is mediated by a cell membrane receptor", Proc. Natl. Acad. Sci. USA, 1985, vol. 82, p. 3688-3692.

Hwang et al., "Hepatic uptake and degradation of unilamellar sphingomyelin/cholesterol liposomes: A kinetic study", Proc. Natl Acad. Sci. USA, 1980, vol. 77, No. 7, p. 4030-4034.

Jansen et al., "Immunotoxins: Hybrid Molecules Combining High Specificity and Potent Cytotoxicity", Immunological Reviews, 1982, vol. 62, p. 185-216.

Killen and Lindstrom, "Specific killing of lymphocytes that cause experimental autoimmune myasthenia gravis by ricin toxin-acetylcholine receptor conjugates", Journal of Immunology, 1984, vol. 133, No. 5, p. 1335-2549.

LaPlanche et al. "Phosphorothioate-modified oligodeoxyribonucleotides. III. NMR and UV spectroscoptc studies of the Rp-Rp, Sp-Sp, and Rp-Sp duplexes, [dCGGsAATTCC)], derived from diastereomeric 0-ethyl pbospborothfoates", Nucleic Acids Research, 1986, vol. 14, No. 22, p. 9081-9093.

Malmqvist, M. "Biospecfic interaction analysis using biosensor technology", Nature, 1993, vol. 361, p. 186-187.

Marasco et al., "Design, intracellular expression, and activity of a human anti-human immunodeficiency virus type 1 gp120 single-chain antibody", Proc. Natl. Acad. Sci. USA, 1993, vol. 90, p. 7889-7893.

Martin et al. "Irreversible Coupling of Immunoglobulin Fragments to Preformed Vesicles", J. Biol. Chem., 1982, vol. 257, No. 1, p. 286-288.

Mitra and Lawton, "Reagents for the Cross-Linking of Proteins by Equilibrium Transfer Alkylation", Journal of Amer. Chem. Soc. 1979, vol. 101, p. 3097-3110.

Powell et al. "Compendium of excipients for parenteral formulations" PDA Journal of Pharmaceutical Science and Technology, 1998, vol. 52, p. 238-311.

Ramakrishnan, S. et al., "Comparison of the Selective Cytotoxic Effects of Immunotoxins Containing Ricin A Chain or Pokeweed Antiviral Protein and Anti-Thy 1.1 Monoclonal Antibodies", Cancer Research, 1984, vol. 44, p. 201-208.

Stec et al. "Automated Solid-Phase Synthesis, Separation, and Stereochemistry of Phosphorothioate Analogues of Oligodeoxyribonucleotides", J. Am. Chem. Soc., 1984, vol. 106, No. 20, p. 6077-6079.

Stein et al. "Physicochemical properties of phosphorothioate oligodeoxynucleotides", Nucl. Acids Res., 1988, vol. 16, No. 8, p. 3209-3221.

Thornton et al. "Prediction of progress at last", Nature, 1991, vol. 354, p. 105-106.

Uhlmann and Peyman "Antisense Oligonucleotides: A New Therapeutic Principle", Chemical Reviews, 1990, vol. 90, No. 4, p. 543-584.

Vitetta et al., "Redesigning Nature's Poisons to Create Anti-Tumor Reagents", Science, 1987, vol. 238, p. 1098-1104.

Wang W. "Lyophilization and development of solid protein pharmaceuticals." International Journal of Pharmaceutics, 2000, vol. 203, p. 1-60.

Zon et al. "Phosphorothioate oligonucleotides: chemistry, purification, analysis, scale-up and future directions", Anti Cancer Drug Design, 1991, vol. 6, p. 539-568.

* cited by examiner

FIGURE 2, cont'd

| Activatable Antibody | $K_D$ | fold masking |
|---|---|---|
| huCD71 TF01.01-2001 | 994.7 | 433 |
| huCD71 TF01.02-2001 | 420.5 | 183 |
| huCD71 TF01.03-2001 | 320.9 | 140 |
| huCD71 TF01.04-2001 | 198.7 | 86 |
| huCD71 TF01.05-2001 | 245.4 | 107 |
| huCD71 TF01.06-2001 | 545.3 | 237 |
| huCD71 TF01.07-2001 | 458.8 | 199 |
| huCD71 TF01.08-2001 | 183.3 | 80 |
| huCD71 TF02.09-2001 | 974.3 | 426 |
| huCD71 TF02.10-2001 | 74.5 | 32 |
| huCD71 TF02.11-2001 | 265.6 | 115 |
| huCD71 TF02.12-2001 | 127.4 | 55 |
| huCD71 TF02.13-2001 | 227.2 | 99 |
| huCD71 TF02.14-2001 | 654.8 | 285 |
| huCD71 TF02.15-2001 | 79.93 | 35 |
| huCD71 TF02.16-2001 | 885.5 | 385 |
| huCD71 TF02.17-2001 | 32.04 | 14 |
| huCD71 TF02.18-2001 | 809.5 | 352 |
| huCD71 TF01-2001 | | |
| huCD71 21.12 Ab | 2.298 | 1 |

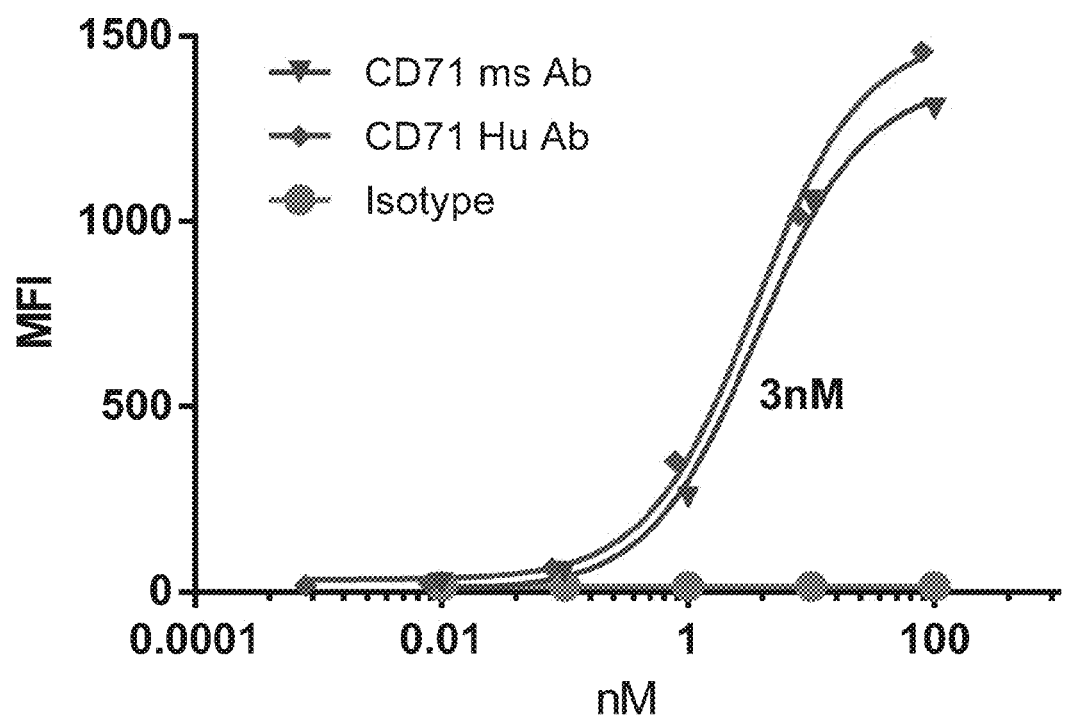

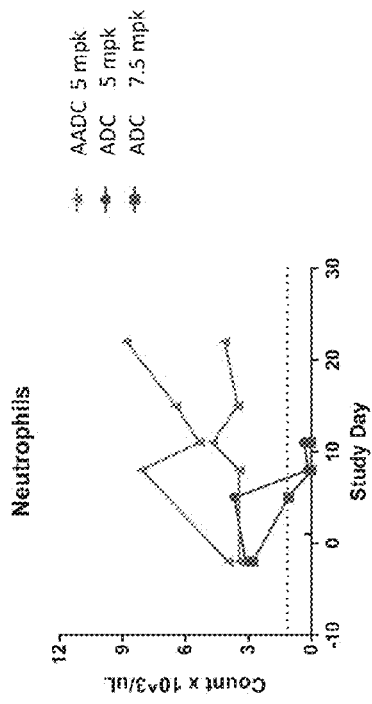
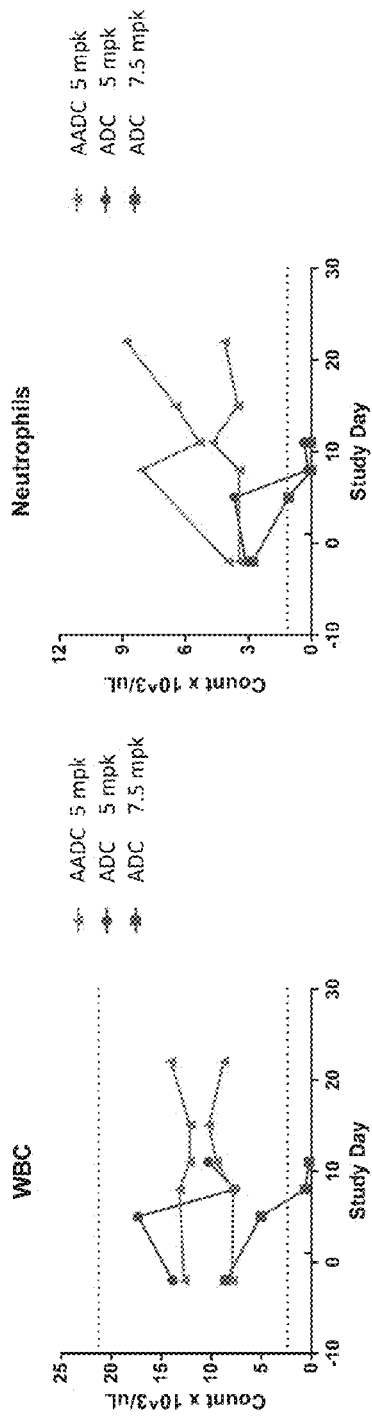
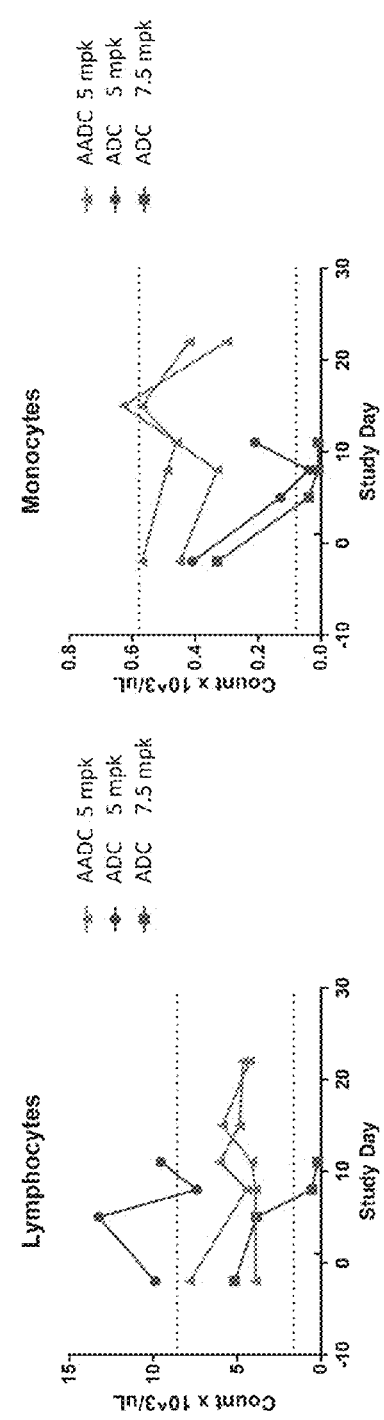
FIGURE 14A
FIGURE 14B
FIGURE 14C
FIGURE 14D

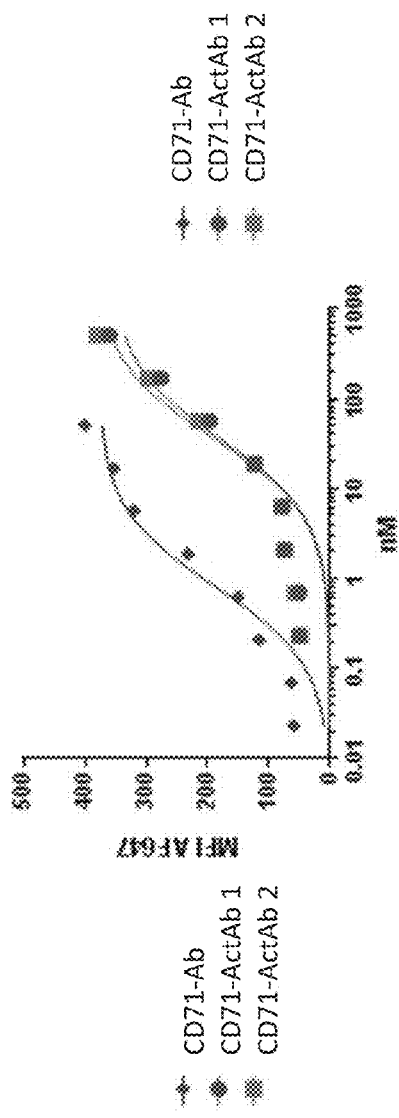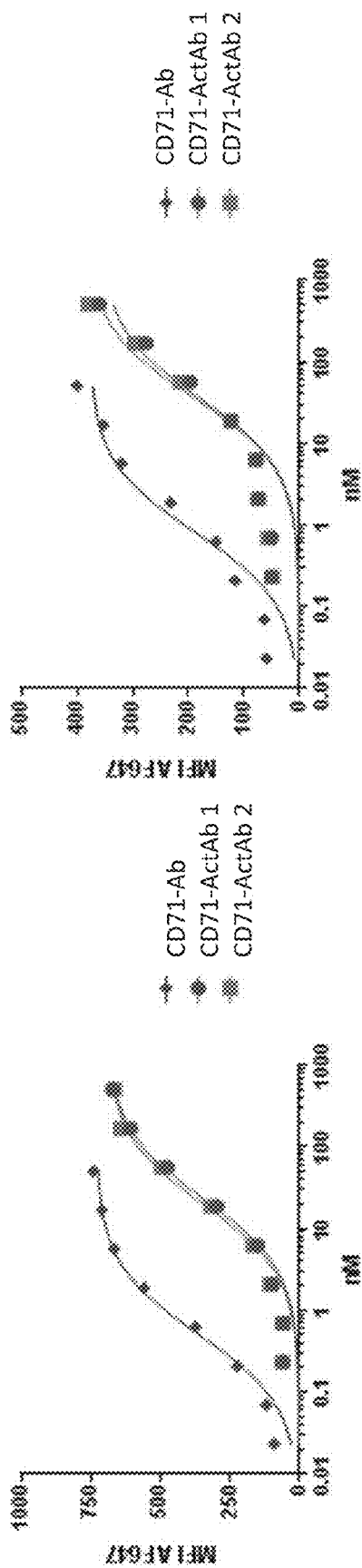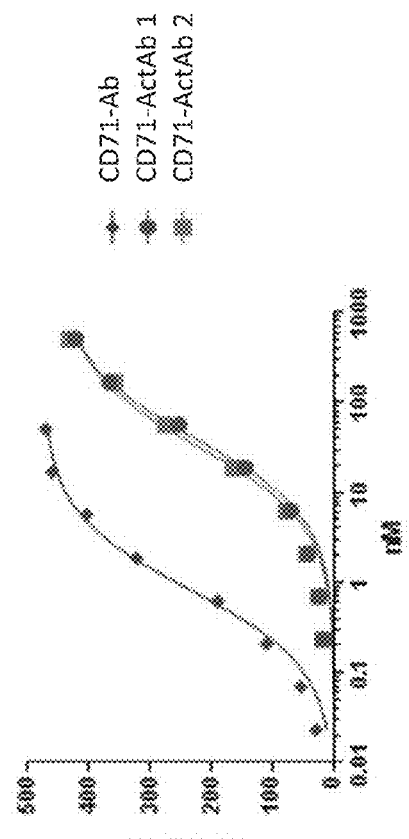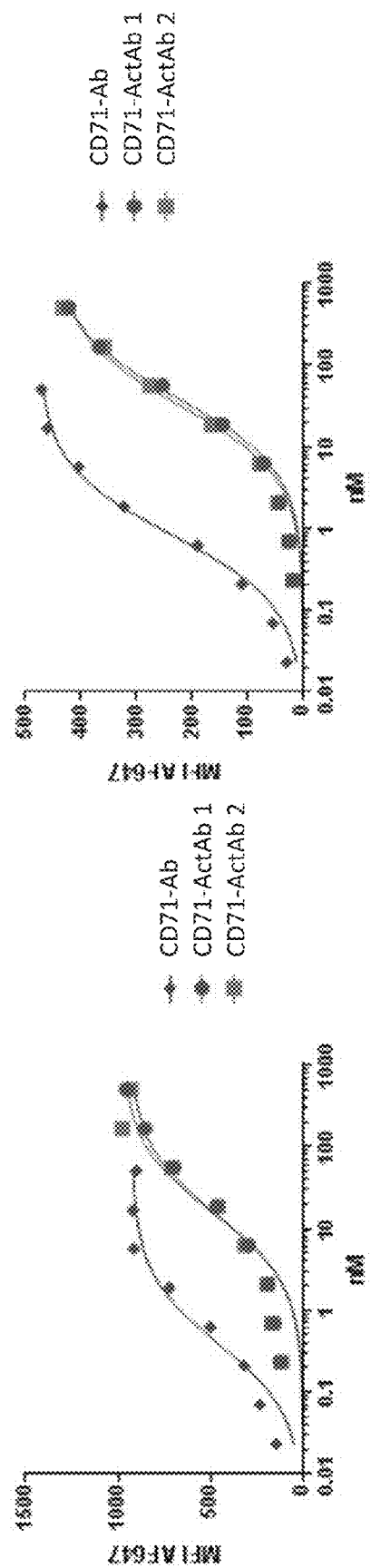
FIGURE 16A: HT29 Cells
FIGURE 16B: BXPc3 Cells
FIGURE 16C: Fadu Cells
FIGURE 16D: MDA MB231 Cells Model LY2214

Model LY0257

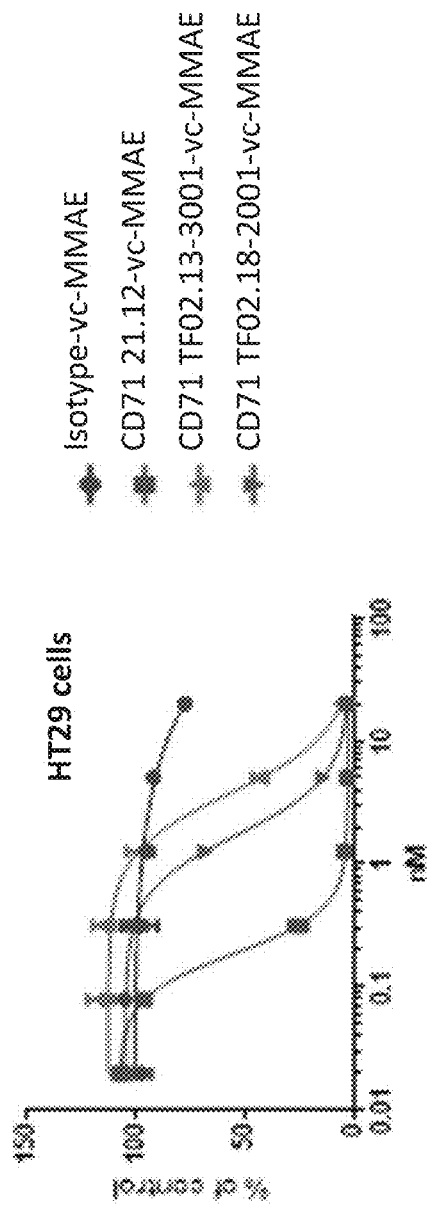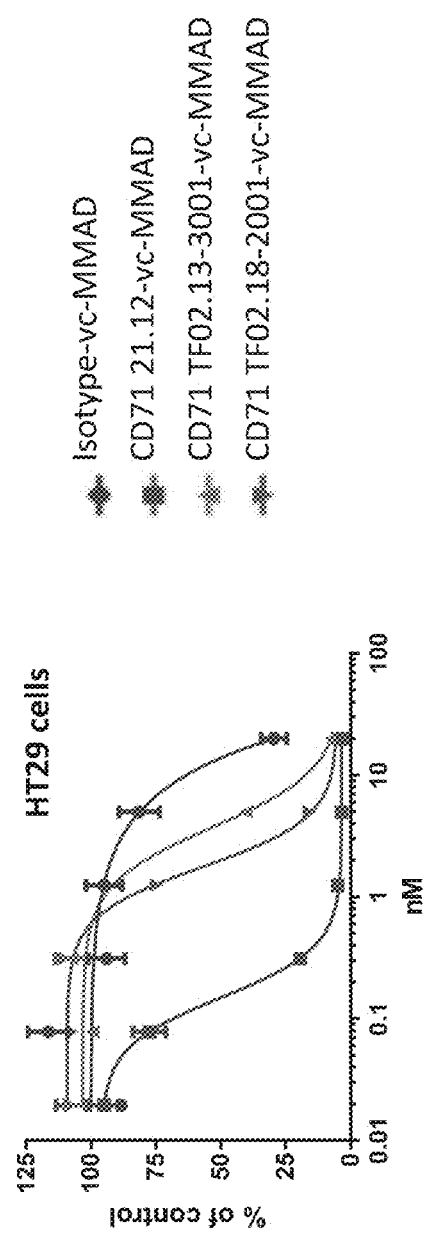

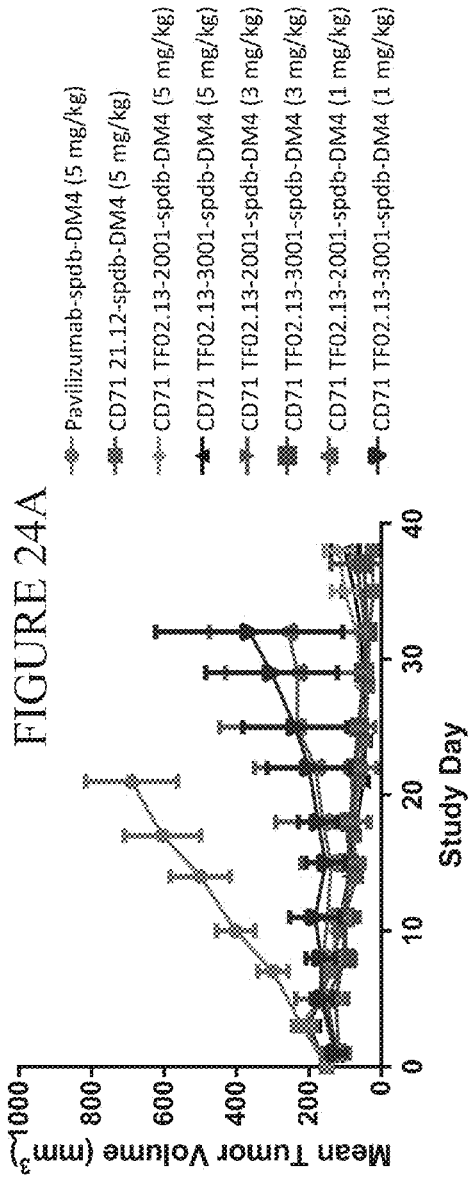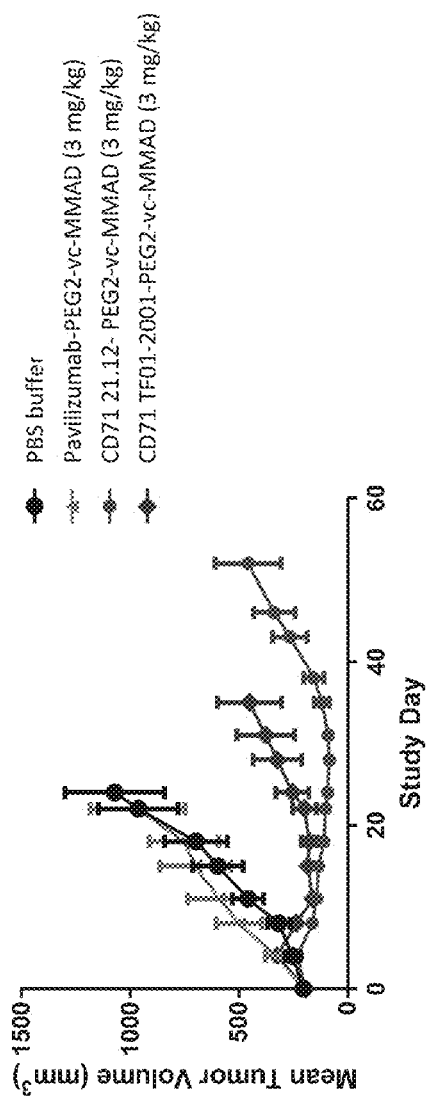
FIGURE 24A
FIGURE 24B

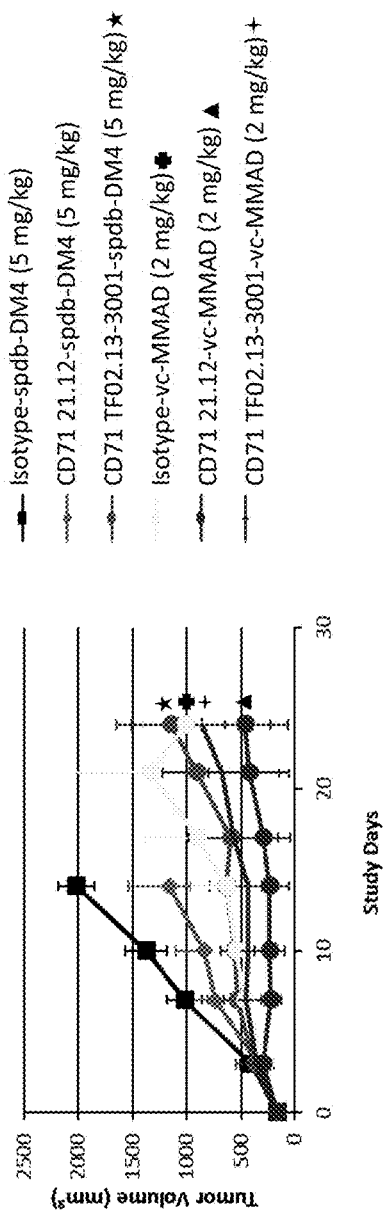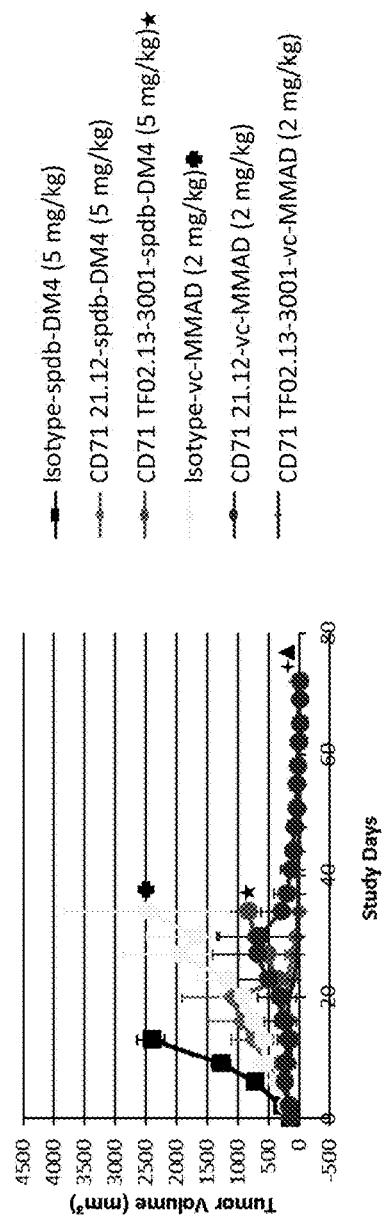
FIGURE 26A
FIGURE 26B

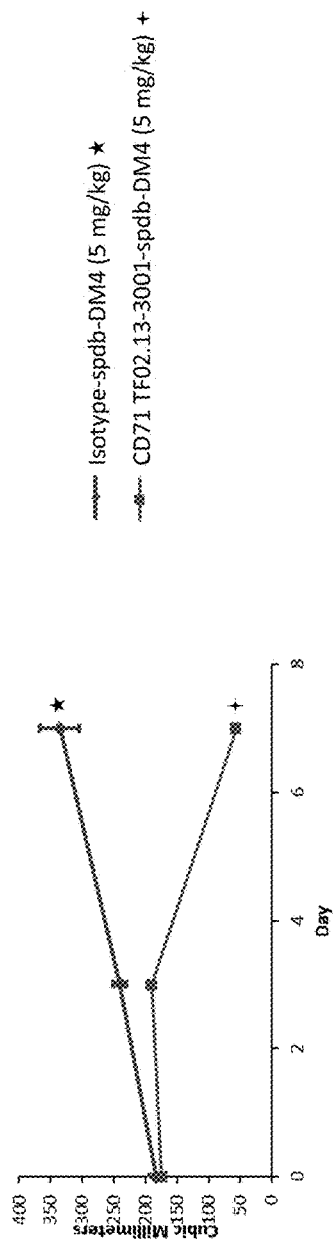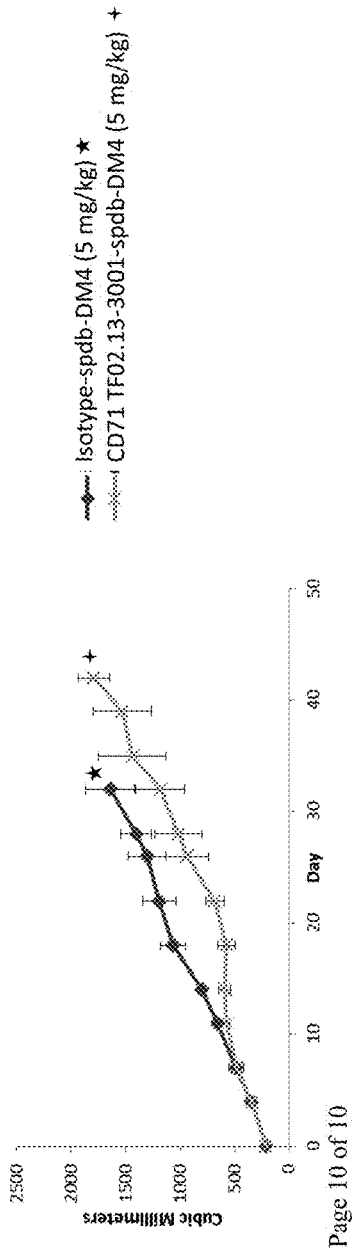

ANTI-CD71 ANTIBODIES, ACTIVATABLE ANTI-CD71 ANTIBODIES, AND METHODS OF USE THEREOF

RELATED APPLICATIONS

This application claims the benefit under of U.S. Provisional Application Nos. 62/156,838, filed May 4, 2015; 62/257,321, filed Nov. 19, 2015; 62/257,484, filed Nov. 19, 2015; 62/277,775, filed Jan. 12, 2016; 62/310,553, filed Mar. 18, 2016; and 62/315,276, filed Mar. 30, 2016, the contents of each of which are incorporated herein by reference in their entirety.

The contents of the text file named "CYTM_040_001US_SubSeqList_11_ST25_11_09_2018", which was created on Nov. 13, 2018 and is 684 KB in size, are hereby incorporated by reference in their entirety.

FIELD OF THE INVENTION

The invention relates generally to antibodies that bind CD71, activatable antibodies that specifically bind to CD71 and methods of making and using these anti-CD71 antibodies and anti-CD71 activatable antibodies in a variety of therapeutic, diagnostic and prophylactic indications.

BACKGROUND OF THE INVENTION

Antibody-based therapies have proven effective treatments for several diseases but in some cases, toxicities due to broad target expression have limited their therapeutic effectiveness. In addition, antibody-based therapeutics have exhibited other limitations such as rapid clearance from the circulation following administration.

In the realm of small molecule therapeutics, strategies have been developed to provide prodrugs of an active chemical entity. Such prodrugs are administered in a relatively inactive (or significantly less active) form. Once administered, the prodrug is metabolized in vivo into the active compound. Such prodrug strategies can provide for increased selectivity of the drug for its intended target and for a reduction of adverse effects.

Accordingly, there is a continued need in the field of antibody-balsed therapeutics for antibodies that mimic the desirable characteristics of the small molecule prodrug.

SUMMARY OF THE INVENTION

The disclosure provides antibodies or antigen-binding fragments thereof that specifically bind CD71, also known as transferrin receptor protein 1 (TfR1).

In some embodiments, the antibody includes an antibody or antigen-binding fragment thereof that specifically binds CD71. In some embodiments, the antibody or antigen-binding fragment thereof that binds CD71 is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, such an antibody or antigen-binding fragment thereof that binds CD71 is a mouse, other rodent, chimeric, humanized or fully human monoclonal antibody.

In some embodiments, the antibody or antigen-binding fragment thereof comprises a heavy chain variable region amino acid sequence selected from the group consisting of SEQ ID NO: 1, and 3-5. In some embodiments, the antibody or antigen-binding fragment thereof comprises a heavy chain variable region amino acid sequence selected from the group consisting of SEQ ID NO: 3-5.

In some embodiments, the antibody or antigen-binding fragment thereof comprises a light chain variable region amino acid sequence selected from the group consisting of SEQ ID NO: 2 and 6-8. In some embodiments, the antibody or antigen-binding fragment thereof comprises a light chain variable region amino acid sequence selected from the group consisting of SEQ ID NO: 6-8.

In some embodiments, the antibody or antigen-binding fragment thereof comprises a heavy chain variable region amino acid sequence selected from the group consisting of SEQ ID NO: 1 and 3-5, and a light chain variable region amino acid sequence or antigen-binding fragment thereof selected from the group consisting of SEQ ID NO: 2 and 6-8.

In some embodiments, the antibody or antigen-binding fragment thereof comprises a heavy chain variable region amino acid sequence selected from the group consisting of SEQ ID NO: 3-5, and a light chain variable region amino acid sequence selected from the group consisting of SEQ ID NO: 6-8.

In some embodiments, the antibody or antigen-binding fragment thereof comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 1 and 3-5. In some embodiments, the antibody or antigen-binding fragment thereof comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 3-5.

In some embodiments, the antibody or antigen-binding fragment thereof comprises a light chain variable region amino acid sequence that is at least 90%, 91%, 92%, 93%, 94%, 95%, 96%, 97%, 98% or 99% identical to an amino acid sequence selected from the group consisting of SEQ ID NO: 2 and 6-8. In some embodiments, the antibody or antigen-binding fragment thereof comprises a light chain variable region amino acid sequence that is at least 90%, 91%, 92%, 93%, 94%, 95%, 96%, 97%, 98% or 99% identical to an amino acid sequence selected from the group consisting of SEQ ID NO: 6-8.

In some embodiments, the antibody or antigen-binding fragment thereof comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 1 and 3-5, and a light chain variable region amino acid sequence that is at least 90%, 91%, 92%, 93%, 94%, 95%, 96%, 97%, 98% or 99% identical to an amino acid sequence selected from the group consisting of SEQ ID NO: 2 and 6-8.

In some embodiments, the antibody or antigen-binding fragment thereof comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 3-5, and a light chain variable region amino acid sequence that is at least 90%, 91%, 92%, 93%, 94%, 95%, 96%, 97%, 98% or 99% identical to an amino acid sequence selected from the group consisting of SEQ ID NO: 6-8.

In some embodiments, the antibody or antigen-binding fragment thereof comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one complementarity determining region (CDR) sequence is selected from the group consisting of a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

In some embodiments, the antibody or antigen-binding fragment thereof comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence comprising the amino acid sequence GYTFTSYWMH (SEQ ID NO: 9); a VH CDR2 sequence that includes a sequence that is at least 90%, 91%, 92%, 93%, 94%, 95%, 96%, 97%, 98%, 99% or more identical to a VH CDR2 sequence comprising the amino acid sequence AIYPGNSETG (SEQ ID NO: 10); a VH CDR3 sequence that includes a sequence that is at least 90%, 91%, 92%, 93%, 94%, 95%, 96%, 97%, 98%, 99% or more identical to a VH CDR3 sequence comprising the amino acid sequence ENWDPGFAF (SEQ ID NO: 11); a VL CDR1 sequence that includes a sequence that is at least 90%, 91%, 92%, 93%, 94%, 95%, 96%, 97%, 98%, 99% or more identical to a VL CDR1 sequence comprising the amino acid sequence SASSSVYYMY (SEQ ID NO: 12) or CRASSSVYYMY (SEQ ID NO: 13); a VL CDR2 sequence that includes a sequence that is at least 90%, 91%, 92%, 93%, 94%, 95%, 96%, 97%, 98%, 99% or more identical to a VL CDR2 sequence comprising the amino acid sequence STSNLAS (SEQ ID NO: 14); and a VL CDR3 sequence that includes a sequence that is at least 90%, 91%, 92%, 93%, 94%, 95%, 96%, 97%, 98%, 99% or more identical to a VL CDR3 sequence comprising the amino acid sequence QQRRNYPYT (SEQ ID NO: 15).

In some embodiments, the antibody or antigen-binding fragment thereof comprises a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises the amino acid sequence GYTFTSYWMH (SEQ ID NO: 9); the VH CDR2 sequence comprises the amino acid sequence AIYPGNSETG (SEQ ID NO: 10); the VH CDR3 sequence comprises the amino acid sequence ENWDPGFAF (SEQ ID NO: 11); the VL CDR1 sequence comprises the amino acid sequence SASSSVYYMY (SEQ ID NO: 12) or CRASSSVYYMY (SEQ ID NO: 13); the VL CDR2 sequence comprises the amino acid sequence STSNLAS (SEQ ID NO: 14); and the VL CDR3 sequence comprises the amino acid sequence QQRRNYPYT (SEQ ID NO: 15).

In some embodiments, the antibody or antigen-binding fragment thereof comprises a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to the amino acid sequence GYTFTSYWMH (SEQ ID NO: 9); the VH CDR2 sequence comprises a sequence that is at least 90%, 91%, 92%, 93%, 94%, 95%, 96%, 97%, 98%, 99% or more identical to the amino acid sequence AIYPGNSETG (SEQ ID NO: 10); the VH CDR3 sequence comprises a sequence that is at least 90%, 91%, 92%, 93%, 94%, 95%, 96%, 97%, 98%, 99% or more identical to the amino acid sequence ENWDPGFAF (SEQ ID NO: 11); the VL CDR1 sequence comprises a sequence that is at least 90%, 91%, 92%, 93%, 94%, 95%, 96%, 97%, 98%, 99% or more identical to the amino acid sequence SASSSVYYMY (SEQ ID NO: 12) or CRASSSVYYMY (SEQ ID NO: 13); the VL CDR2 sequence comprises a sequence that is at least 90%, 91%, 92%, 93%, 94%, 95%, 96%, 97%, 98%, 99% or more identical to the amino acid sequence STSNLAS (SEQ ID NO: 14); and the VL CDR3 sequence a sequence that is at least 90%, 91%, 92%, 93%, 94%, 95%, 96%, 97%, 98%, 99% or more identical to comprises the amino acid sequence QQRRNYPYT (SEQ ID NO: 15).

In some embodiments, the antibody or antigen-binding fragment thereof is encoded by a nucleic acid sequence that comprises a nucleic acid sequence encoding a heavy chain amino acid sequence comprising an amino acid sequence selected from the group consisting of SEQ ID NO: 1 and 3-5. In some embodiments, the antibody or antigen-binding fragment thereof is encoded by a nucleic acid sequence that comprises a nucleic acid sequence encoding a heavy chain amino acid sequence comprising an amino acid sequence selected from the group consisting of SEQ ID NO: 3-5.

In some embodiments, the antibody or antigen-binding fragment thereof is encoded by a nucleic acid sequence that comprises a nucleic acid sequence encoding a light chain amino acid sequence comprising an amino acid sequence selected from the group consisting of SEQ ID NO: 2 and 6-8. In some embodiments, the antibody or antigen-binding fragment thereof is encoded by a nucleic acid sequence that comprises a nucleic acid sequence encoding a light chain amino acid sequence comprising an amino acid sequence selected from the group consisting of SEQ ID NO: 6-8.

In some embodiments, the antibody or antigen-binding fragment thereof is encoded by a nucleic acid sequence that comprises a nucleic acid sequence encoding a heavy chain amino acid sequence comprising an amino acid sequence selected from the group consisting of SEQ ID NO: 1 and 3-5, and a nucleic acid sequence encoding a light chain amino acid sequence comprising an amino acid sequence selected from the group consisting of SEQ ID NO: 2 and 6-8.

In some embodiments, the antibody or antigen-binding fragment thereof is encoded by a nucleic acid sequence that comprises a nucleic acid sequence encoding a heavy chain amino acid sequence comprising an amino acid sequence selected from the group consisting of SEQ ID NO: 3-5, and a nucleic acid sequence encoding a light chain amino acid sequence comprising an amino acid sequence selected from the group consisting of SEQ ID NO: 6-8.

In some embodiments, the antibody or antigen-binding fragment thereof is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain amino acid sequence comprising an amino acid sequence selected from the group consisting of SEQ ID NO: 1 and 3-5. In some embodiments, the antibody or antigen-binding fragment thereof is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain amino acid sequence comprising an amino acid sequence selected from the group consisting of SEQ ID NO: 3-5.

In some embodiments, the antibody or antigen-binding fragment thereof is encoded by a nucleic acid sequence that comprises a nucleic acid sequence that is at least 90%, 91%, 92%, 93%, 94%, 95%, 96%, 97%, 98% or 99% identical to a nucleic acid sequence encoding a light chain amino acid sequence comprising an amino acid sequence selected from the group consisting of SEQ ID NO: 2 and 6-8. In some embodiments, the antibody or antigen-binding fragment thereof is encoded by a nucleic acid sequence that comprises a nucleic acid sequence that is at least 90%, 91%, 92%, 93%, 94%, 95%, 96%, 97%, 98% or 99% identical to a nucleic acid sequence encoding a light chain amino acid sequence comprising an amino acid sequence selected from the group consisting of SEQ ID NO: 6-8.

In some embodiments, the antibody or antigen-binding fragment thereof is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain amino acid sequence comprising an amino acid sequence selected from the group consisting of SEQ ID NO: 1 and 3-5, and a nucleic acid sequence that is at least 90%, 91%, 92%, 93%, 94%, 95%, 96%, 97%, 98% or 99% identical to a nucleic acid sequence encoding a light chain amino acid sequence comprising an amino acid sequence selected from the group consisting of SEQ ID NO: 2 and 6-8.

In some embodiments, the antibody or antigen-binding fragment thereof is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain amino acid sequence comprising an amino acid sequence selected from the group consisting of SEQ ID NO: 3-5, and a nucleic acid sequence that is at least 90%, 91%, 92%, 93%, 94%, 95%, 96%, 97%, 98% or 99% identical to a nucleic acid sequence encoding a light chain amino acid sequence comprising an amino acid sequence selected from the group consisting of SEQ ID NO: 6-8.

The disclosure also provides methods for producing an antibody of the disclosure by culturing a cell under conditions that lead to expression of the antibody, wherein the cell comprises a nucleic acid molecule of the disclosure or a vector of the disclosure.

In some embodiments, the antibody or antigen-binding fragment thereof is incorporated in a multispecific antibody or antigen-binding fragment thereof, where at least one arm of the multispecific antibody or antigen-binding fragment thereof specifically binds CD71. In some embodiments, the antibody or antigen-binding fragment thereof is incorporated in a bispecific antibody or antigen-binding fragment thereof, where at least one arm of the bispecific antibody or antigen-binding fragment thereof specifically binds CD71.

In some embodiments, at least one arm of the multi specific antibody or antigen-binding fragment thereof, e.g., a bispecific antibody or antigen-binding fragment thereof, comprises a heavy chain variable region amino acid sequence selected from the group consisting of SEQ ID NO: 1 and 3-5. In some embodiments, at least one arm of the multispecific antibody or antigen-binding fragment thereof, e.g., a bispecific antibody or antigen-binding fragment thereof, comprises a heavy chain variable region amino acid sequence selected from the group consisting of SEQ ID NO: 3-5.

In some embodiments, at least one arm of the multispecific antibody or antigen-binding fragment thereof, e.g., a bispecific antibody or antigen-binding fragment thereof, comprises a light chain variable region amino acid sequence selected from the group consisting of SEQ ID NO: 2 and 6-8. In some embodiments, at least one arm of the multispecific antibody or antigen-binding fragment thereof, e.g., a bispecific antibody or antigen-binding fragment thereof, comprises a light chain variable region amino acid sequence selected from the group consisting of SEQ ID NO: 6-8.

In some embodiments, at least one arm of the multispecific antibody or antigen-binding fragment thereof, e.g., a bispecific antibody or antigen-binding fragment thereof, comprises a heavy chain variable region amino acid sequence selected from the group consisting of SEQ ID NO: 1 and 3-5, and a light chain variable region amino acid sequence selected from the group consisting of SEQ ID NO: 2 and 6-8.

In some embodiments, at least one arm of the multispecific antibody or antigen-binding fragment thereof, e.g., a bispecific antibody or antigen-binding fragment thereof, comprises a heavy chain variable region amino acid sequence c selected from the group consisting of SEQ ID NO: 3-5, and a light chain variable region amino acid sequence selected from the group consisting of SEQ ID NO: 6-8.

In some embodiments, at least one arm of the multispecific antibody or antigen-binding fragment thereof, e.g., a bispecific antibody or antigen-binding fragment thereof, comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 1 and 3-5. In some embodiments, at least one arm of the multispecific antibody or antigen-binding fragment thereof, e.g., a bispecific antibody or antigen-binding fragment thereof, comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 3-5.

In some embodiments, at least one arm of the multispecific antibody or antigen-binding fragment thereof, e.g., a bispecific antibody or antigen-binding fragment thereof, comprises a light chain variable region amino acid sequence that is at least 90%, 91%, 92%, 93%, 94%, 95%, 96%, 97%, 98% or 99% identical to an amino acid sequence selected from the group consisting of SEQ ID NO: 2 and 6-8. In some embodiments, at least one arm of the multispecific antibody or antigen-binding fragment thereof, e.g., a bispecific antibody or antigen-binding fragment thereof, comprises a light chain variable region amino acid sequence that is at least 90%, 91%, 92%, 93%, 94%, 95%, 96%, 97%, 98% or 99% identical to an amino acid sequence selected from the group consisting of SEQ ID NO: 6-8.

In some embodiments, at least one arm of the multispecific antibody or antigen-binding fragment thereof, e.g., a bispecific antibody or antigen-binding fragment thereof, comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 1 and 3-5, and a light chain variable region amino acid sequence that is at least 90%, 91%, 92%, 93%, 94%, 95%, 96%, 97%, 98% or 99% identical to an amino acid sequence selected from the group consisting of SEQ ID NO: 2 and 6-8.

In some embodiments, at least one arm of the multispecific antibody or antigen-binding fragment thereof, e.g., a bispecific antibody or antigen-binding fragment thereof, comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 3-5, and a light chain variable region amino acid sequence that is at least 90%, 91%, 92%, 93%, 94%, 95%, 96%, 97%, 98% or 99% identical to an amino acid sequence selected from the group consisting of SEQ ID NO: 6-8.

In some embodiments, at least one arm of the multispecific antibody or antigen-binding fragment thereof, e.g., a bispecific antibody or antigen-binding fragment thereof, comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one complementarity determining region (CDR) sequence is selected from the group consisting of a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

In some embodiments, at least one arm of the multispecific antibody or antigen-binding fragment thereof, e.g., a bispecific antibody or antigen-binding fragment thereof, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence comprising the amino acid sequence GYTFTSYWMH (SEQ ID NO: 9); a VH CDR2 sequence that includes a sequence that is at least 90%, 91%, 92%, 93%, 94%, 95%, 96%, 97%, 98%, 99% or more identical to a VH CDR2 sequence comprising the amino acid sequence AIYPGNSETG (SEQ ID NO: 10); a VH CDR3 sequence that includes a sequence that is at least 90%, 91%, 92%, 93%, 94%, 95%, 96%, 97%, 98%, 99% or more identical to a VH CDR3 sequence comprising the amino acid sequence ENWDPGFAF (SEQ ID NO: 11); a VL CDR1 sequence that includes a sequence that is at least 90%, 91%, 92%, 93%, 94%, 95%, 96%, 97%, 98%, 99% or more identical to a VL CDR1 sequence comprising the amino acid sequence ASSSVYYMY (SEQ ID NO: 12) or CRASSSVYYMY (SEQ ID NO: 13); a VL CDR2 sequence that includes a sequence that is at least 90%, 91%, 92%, 93%, 94%, 95%, 96%, 97%, 98%, 99% or more identical to a VL CDR2 sequence comprising the amino acid sequence STSNLAS (SEQ ID NO: 14); and a VL CDR3 sequence that includes a sequence that is at least 90%, 91%, 92%, 93%, 94%, 95%, 96%, 97%, 98%, 99% or more identical to a VL CDR3 sequence comprising the amino acid sequence QQRRNYPYT (SEQ ID NO: 15).

In some embodiments, at least one arm of the multispecific antibody or antigen-binding fragment thereof, e.g., a bispecific antibody or antigen-binding fragment thereof, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises the amino acid sequence GYTFTSYWMH (SEQ ID NO: 9); the VH CDR2 sequence comprises the amino acid sequence AIYPGNSETG (SEQ ID NO: 10); the VH CDR3 sequence comprises the amino acid sequence ENWDPGFAF (SEQ ID NO: 11); the VL CDR1 sequence comprises the amino acid sequence SASSSVYYMY (SEQ ID NO: 12) or CRASSSVYYMY (SEQ ID NO: 13); the VL CDR2 sequence comprises the amino acid sequence STSNLAS (SEQ ID NO: 14); and the VL CDR3 sequence comprises the amino acid sequence QQRRNYPYT (SEQ ID NO: 15).

In some embodiments, at least one arm of the multispecific antibody or antigen-binding fragment thereof, e.g., a bispecific antibody or antigen-binding fragment thereof, comprises a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to the amino acid sequence GYTFTSYWMH (SEQ ID NO: 9); the VH CDR2 sequence comprises a sequence that is at least 90%, 91%, 92%, 93%, 94%, 95%, 96%, 97%, 98%, 99% or more identical to the amino acid sequence AIYPGNSETG (SEQ ID NO: 10); the VH CDR3 sequence comprises a sequence that is at least 90%, 91%, 92%, 93%, 94%, 95%, 96%, 97%, 98%, 99% or more identical to the amino acid sequence ENWDPGFAF (SEQ ID NO: 11); the VL CDR1 sequence comprises a sequence that is at least 90%, 91%, 92%, 93%, 94%, 95%, 96%, 97%, 98%, 99% or more identical to the amino acid sequence SASSSVYYMY (SEQ ID NO: 12) or CRASSSVYYMY (SEQ ID NO: 13); the VL CDR2 sequence comprises a sequence that is at least 90%, 91%, 92%, 93%, 94%, 95%, 96%, 97%, 98%, 99% or more identical to the amino acid sequence STSNLAS (SEQ ID NO: 14); and the VL CDR3 sequence comprises a sequence that is at least 90%, 91%, 92%, 93%, 94%, 95%, 96%, 97%, 98%, 99% or more identical to the amino acid sequence QQRRNYPYT (SEQ ID NO: 15).

In some embodiments, at least one arm of the multi specific antibody or antigen-binding fragment thereof, e.g., a bispecific antibody or antigen-binding fragment thereof, comprises a heavy chain or a heavy chain variable region that comprises or is derived from a heavy chain amino acid sequence or heavy chain variable region amino acid sequence shown in Table 12. In some embodiments, at least one arm of the multispecific antibody or antigen-binding fragment thereof, e.g., a bispecific antibody or antigen-binding fragment thereof, comprises a light chain or a light chain variable region that comprises or is derived from a light chain amino acid sequence or light chain variable region amino acid sequence shown in Table 12. In some embodiments, at least one arm of the multispecific antibody or antigen-binding fragment thereof, e.g., a bispecific antibody or antigen-binding fragment thereof, comprises a heavy chain or a heavy chain variable region amino acid sequence that comprises or is derived from a heavy chain amino acid sequence or heavy chain variable region amino acid sequence shown in Table 12 and a light chain or a light chain variable region amino acid sequence that comprises or is derived from a light chain amino acid sequence or light chain variable region amino acid sequence shown in Table 12.

In some embodiments, at least one arm of the multispecific antibody or antigen-binding fragment thereof, e.g., a bispecific antibody or antigen-binding fragment thereof, comprises a heavy chain variable region amino acid sequence that is at least 90%, 91%, 92%, 93%, 94%, 95%, 96%, 97%, 98% or 99% identical to an amino acid sequence selected from the group consisting of the heavy chain variable region sequences shown in Table 12. In some embodiments, at least one arm of the multispecific antibody or antigen-binding fragment thereof, e.g., a bispecific antibody or antigen-binding fragment thereof, comprises an amino acid sequence that is at least 90%, 91%, 92%, 93%, 94%, 95%, 96%, 97%, 98% or 99% identical to an amino acid sequence that is selected from the group consisting of the light chain variable region sequences shown in Table 12. In some embodiments, at least one arm of the multispecific antibody or antigen-binding fragment thereof, e.g., a bispecific antibody or antigen-binding fragment thereof, comprises an amino acid sequence that is at least 90%, 91%, 92%, 93%, 94%, 95%, 96%, 97%, 98% or 99%, identical to an amino acid sequence selected from the group consisting of the heavy chain variable region sequences shown in Table 12 and a light chain variable region amino acid sequence that is at least 90%, 91%, 92%, 93%, 94%, 95%, 96%, 97%, 98% or 99% identical to an amino acid sequence selected from the group consisting of the light chain variable region sequences shown in Table 12.

In some embodiments, at least one arm of the multispecific antibody or antigen-binding fragment thereof, e.g., a bispecific antibody or antigen-binding fragment thereof, comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 13; a VH CDR2 sequence shown in Table 13; a VH CDR3 sequence shown in Table 13; a VL CDR1 sequence shown in Table 13; a VL CDR2 sequence shown in Table 13; and a VL CDR3 sequence shown in Table 13.

In some embodiments, at least one arm of the multispecific antibody or antigen-binding fragment thereof, e.g., a bispecific antibody or antigen-binding fragment thereof, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 13; a VH CD2 sequence that includes a sequence that is at least 90%, 91%, 92%, 93%, 94%, 95%, 96%, 97%, 98%, 99% or more identical to a VH CDR2 sequence shown in Table 13; a VH CDR3 sequence that includes a sequence that is at least 90%, 91%, 92%, 93%, 94%, 95%, 96%, 97%, 98%, 99% or more identical to a VH CDR3 sequence shown in Table 13; a VL CDR1 sequence that includes a sequence that is at least 90%, 91%, 92%, 93%, 94%, 95%, 96%, 97%, 98%, 99% or more identical to a VL CDR1 sequence shown in Table 13; a VL CDR2 sequence that includes a sequence that is at least 90%, 91%, 92%, 93%, 94%, 95%, 96%, 97%, 98%, 99% or more identical to a VL CDR2 sequence shown in Table 13; and a VL CDR3 sequence that includes a sequence that is at least 90%, 91%, 92%, 93%, 94%, 95%, 96%, 97%, 98%, 99% or more identical to a VL CDR3 sequence shown in Table 13.

In some embodiments at least one arm of the multispecific antibody or antigen-binding fragment thereof, e.g., a bispecific antibody or antigen-binding fragment thereof, comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 13.

In some embodiments, at least one arm of the multispecific antibody or antigen-binding fragment thereof, e.g., a bispecific antibody or antigen-binding fragment thereof, comprises a light chain variable region that comprise a combination of a VL CDR1 sequence, a VL CDR2 sequence, and a VL CDR3 sequence, wherein the combination is a combination of the three light chain CDR sequences (VL CDR1, VL CDR2, VL CDR3) shown in a single row in Table 13.

In some embodiments, at least one arm of the multispecific antibody or antigen-binding fragment thereof, e.g., a bispecific antibody or antigen-binding fragment thereof, comprises a heavy chain variable region that comprise a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 13.

In some embodiments, at least one arm of the multispecific antibody or antigen-binding fragment thereof, e.g., a bispecific antibody or antigen-binding fragment thereof, comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the six CDR sequences (VH CDR1, VH CDR2, VH CDR3, VL CDR1, VL CDR2, and VL CDR3) shown in a single row in Table 13.

In some embodiments, at least one arm of the multispecific antibody or antigen-binding fragment thereof, e.g., a bispecific antibody or antigen-binding fragment thereof, comprises a heavy chain variable region that comprise a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 13.

In some embodiments, at least one arm of the multi specific antibody or antigen-binding fragment thereof, e.g., a bispecific antibody or antigen-binding fragment thereof, comprises a light chain variable region that comprise a combination of a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three light chain CDR sequences (VL CDR1, VL CDR2, VL CDR3) shown in a single row in Table 13.

Suitable anti-CD71 antibodies of the disclosure also include an antibody or antigen binding fragment thereof that binds to the same epitope on human CD71 and/or cynomolgus monkey CD71 as an anti-CD71 antibody comprising a heavy chain variable region amino acid sequence selected from the group consisting of SEQ ID NO: 1 and 3-5, and a light chain variable region amino acid sequence selected from the group consisting of SEQ ID NO: 2 and 6-8.

Suitable anti-CD71 antibodies of the disclosure also include an antibody or antigen binding fragment thereof that binds to the same epitope on human CD71 and/or cynomolgus monkey CD71 as an anti-CD71 antibody comprising a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

Suitable anti-CD71 antibodies of the disclosure also include an antibody or antigen binding fragment thereof that cross-competes for binding to human CD71 and/or cynomolgus monkey CD71 to an anti-CD71 antibody comprising a heavy chain variable region amino acid sequence selected from the group consisting of SEQ ID NO: 1 and 3-5, and a light chain variable region amino acid sequence selected from the group consisting of SEQ ID NO: 2 and 6-8.

Suitable anti-CD71 antibodies of the disclosure also include an antibody or antigen binding fragment thereof that cross-competes for binding to human CD71 and/or cynomolgus monkey CD71 to an anti-CD71 antibody comprising a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

In some embodiments, the anti-CD71 antibody of the disclosure comprises an isolated antibody or an antigen binding fragment thereof (AB) that specifically binds to mammalian CD71, wherein the AB specifically binds human CD71 and cynomolgus monkey CD71. In some embodiments, the antibody or antigen binding fragment thereof comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the antibody or antigen binding fragment thereof comprises a heavy chain variable region comprising an amino acid sequence selected from the group consisting of SEQ ID NOs: 3-5, and a light chain variable region comprising an amino acid sequence selected from the group consisting of SEQ ID NOs: 6-8.

In some embodiments, the isolated antibody or antigen binding fragment thereof binds to the same epitope on human CD71 and/or cynomolgus monkey CD71 as an isolated antibody that comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the isolated antibody or antigen binding fragment thereof binds to the same epitope on human CD71 and/or cynomolgus monkey CD71 as an isolated antibody that comprises a heavy chain variable region comprising an amino acid sequence selected from the group consisting of SEQ ID NOs: 3-5, and a light chain variable region comprising an amino acid sequence selected from the group consisting of SEQ ID NOs: 6-8. In some embodiments, the antigen binding fragment thereof is selected from the group consisting of a Fab fragment, a F(ab')2 fragment, a scFv, a scAb, a dAb, a single domain heavy chain antibody, and a single domain light chain antibody. In some embodiments, the antibody or antigen-binding fragment thereof specifically binds human CD71.

In some embodiments, the isolated antibody or antigen binding fragment thereof cross-competes with an isolated antibody that comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the isolated antibody or antigen binding fragment thereof cross-competes with an isolated antibody that comprises a heavy chain variable region comprising an amino acid sequence selected from the group consisting of SEQ ID NOs: 3-5, and a light chain variable region comprising an amino acid sequence selected from the group consisting of SEQ ID NOs: 6-8.

In some embodiments, antibody or antigen binding fragment thereof is conjugated to an agent. In some embodiments, the isolated antibody or antigen binding fragment thereof cross-competes with an isolated antibody that comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the isolated antibody or antigen binding fragment thereof cross-competes with an isolated antibody that comprises a heavy chain variable region comprising an amino acid sequence selected from the group consisting of SEQ ID NOs: 3-5, and a light chain variable region comprising an amino acid sequence selected from the group consisting of SEQ ID NOs: 6-8. In some embodiments, the agent is a toxin or fragment thereof. In some embodiments, the agent is a microtubule inhibitor. In some embodiments, the agent is a nucleic acid damaging agent. In some embodiments, the agent is selected from the group consisting of a dolastatin or a derivative thereof, an auristatin or a derivative thereof, a maytansinoid or a derivative thereof, a duocarmycin or a derivative thereof, a calicheamicin or a derivative thereof, and a pyrrolobenzodiazepine or a derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid selected from the group consisting of DM1 and DM4. In some embodiments, the agent is maytansinoid DM4. In some embodiments, the agent is duocarmycin. In some embodiments, the agent is conjugated to the AB via a linker. In some embodiments, the linker with which the agent is conjugated to the AB comprises an SPDB moiety, a vc moiety, or a PEG2-vc moiety. In some embodiments, the linker and toxin conjugated to the AB comprises an SPDB-DM4 moiety, a vc-MMAD moiety, a vc-MMAE moiety, vc-duocarmycin, or a PEG2-vc-MMAD moiety. In some embodiments, the linker is a cleavable linker. In some embodiments, the linker is a non-cleavable linker. In some embodiments, the agent is a detectable moiety. In some embodiments, the detectable moiety is a diagnostic agent.

In some embodiments, the conjugated antibody comprises a conjugated antibody comprising: (a) an antibody or an antigen binding fragment thereof (AB) that specifically binds to mammalian CD71, wherein the AB comprises: (i) the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15), or (ii) a heavy chain variable region comprising an amino acid sequence selected from the group consisting of SEQ ID NOs: 3-5, and a light chain variable region comprising an amino acid sequence selected from the group consisting of SEQ ID NOs: 6-8; (b) an agent conjugated to the AB, wherein the agent is selected from the group consisting of auristatin E, monomethyl auristatin F (MMAF), monomethyl auristatin E (MMAE), monomethyl auristatin D (MMAD), maytansinoid DM4, maytansinoid DM1, a pyrrolobenzodiazepine, a pyrrolobenzodiazepine dimer, and a duocarmycin.

The disclosure also provides activatable antibodies that include an antibody or antigen-binding fragment thereof that specifically binds CD71 coupled to a masking moiety (MM), such that coupling of the MM reduces the ability of the antibody or antigen-binding fragment thereof to bind CD71. In some embodiments, the MM is coupled via a sequence that includes a substrate for a protease, for example, a protease that is active in diseased tissue and/or a protease that is co-localized with CD71 at a treatment site in a subject. The activatable anti-CD71 antibodies provided herein, also referred to herein interchangeably as anti-CD71 activatable antibodies or CD71 activatable antibodies, are stable in circulation, activated at intended sites of therapy and/or diagnosis but not in normal, e.g., healthy tissue or other tissue not targeted for treatment and/or diagnosis, and, when activated, exhibit binding to CD71 that is at least comparable to the corresponding, unmodified antibody, also referred to herein as the parental antibody.

The invention also provides methods of treating, preventing and/or delaying the onset or progression of, or alleviating a symptom associated with aberrant expression and/or activity of CD71 in a subject using activatable antibodies that bind CD71, particularly activatable antibodies that bind and neutralize or otherwise inhibit at least one biological activity of CD71 and/or CD71-mediated signaling.

The invention also provides methods of treating, preventing and/or delaying the onset or progression of, or alleviating a symptom associated with the presence, growth, proliferation, metastasis, and/or activity of cells which are expressing CD71 or aberrantly expressing CD71 in a subject using activatable antibodies that bind CD71, particularly activatable antibodies that bind, target, neutralize, kill, or otherwise inhibit at least one biological activity of cells which are expressing or aberrantly expressing CD71.

The invention also provides methods of treating, preventing and/or delaying the onset or progression of, or alleviating a symptom associated with the presence, growth, proliferation, metastasis, and/or activity of cells which are expressing CD71 in a subject using activatable antibodies that bind CD71, particularly activatable antibodies that bind, target, neutralize, kill, or otherwise inhibit at least one biological activity of cells which are expressing CD71.

The invention also provides methods of treating, preventing and/or delaying the onset or progression of, or alleviating a symptom associated with the presence, growth, proliferation, metastasis, and/or activity of cells which are aberrantly expressing CD71 in a subject using activatable antibodies that bind CD71, particularly activatable antibodies that bind, target, neutralize, kill, or otherwise inhibit at least one biological activity of cells which are aberrantly expressing CD71.

The activatable antibodies in an activated state bind CD71 and include (i) an antibody or an antigen binding fragment thereof (AB) that specifically binds to CD71 (ii) a masking moiety (MM) that, when the activatable antibody is in an uncleaved state, inhibits the binding of the AB to CD71; and (c) a cleavable moiety (CM) coupled to the AB, wherein the CM is a polypeptide that functions as a substrate for a protease.

In some embodiments, the activatable antibody in the uncleaved state has the structural arrangement from N-terminus to C-terminus as follows: MM-CM-AB or AB-CM-MM.

In some embodiments, the activatable antibody comprises a linking peptide between the MM and the CM.

In some embodiments, the activatable antibody comprises a linking peptide between the CM and the AB.

In some embodiments, the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM. In some embodiments, the two linking peptides need not be identical to each other.

In some embodiments, at least one of LP1 or LP2 comprises an amino acid sequence selected from the group consisting of $(GS)_n$, $(GGS)_n$, $(GSGGS)_n$ (SEQ ID NO: 339) and $(GGGS)_n$ (SEQ ID NO: 340), where n is an integer of at least one.

In some embodiments, at least one of LP1 or LP2 comprises an amino acid sequence selected from the group consisting of GGSG (SEQ ID NO: 341), GGSGG (SEQ ID NO: 342), GSGSG (SEQ ID NO: 343), GSGGG (SEQ ID NO: 344), GGGSG (SEQ ID NO: 345), and GSSSG (SEQ ID NO: 346).

In some embodiments, LP1 comprises the amino acid sequence GSSGGSGGSGGSG (SEQ ID NO: 347), GSSGGSGGSGG (SEQ ID NO: 348), GSSGGSGGSGGS (SEQ ID NO: 349), GSSGGSGGSGGSGGGS (SEQ ID NO: 350), GSSGGSGGSG (SEQ ID NO: 351), or GSSGGSGGSGS (SEQ ID NO: 352).

In some embodiments, LP2 comprises the amino acid sequence GSS, GGS, GGGS (SEQ ID NO: 353), GSSGT (SEQ ID NO: 354) or GSSG (SEQ ID NO: 355).

In some embodiments, the AB has a dissociation constant of about 100 nM or less for binding to mammalian CD71. In some embodiments, the AB has a dissociation constant of about 10 nM or less for binding to mammalian CD71. In some embodiments, the AB has a dissociation constant of about 5 nM or less for binding to CD71. In some embodiments, the AB has a dissociation constant of about 1 nM or less for binding to CD71. In some embodiments, the AB has a dissociation constant of about 0.5 nM or less for binding to CD71. In some embodiments, the AB has a dissociation constant of about 0.1 nM or less for binding to CD71. In some embodiments, the AB has a dissociation constant of 0.01 nM to 100 nM, 0.01 nM to 10 nM, 0.01 nM to 5 nM, 0.01 nM to 1 nM, 0.01 to 0.5 nM, 0.01 nm to 0.1 nM, 0.01 nm to 0.05 nM, 0.05 nM to 100 nM, 0.05 nM to 10 nM, 0.05 nM to 5 nM, 0.05 nM to 1 nM, 0.05 to 0.5 nM, 0.05 nm to 0.1 nM, 0.1 nM to 100 nM, 0.1 nM to 10 nM, 0.1 nM to 5 nM, 0.1 nM to 1 nM, 0.1 to 0.5 nM, 0.5 nM to 100 nM, 0.5 nM to 10 nM, 0.5 nM to 5 nM, 0.5 nM to 1 nM, 1 nM to 100 nM, 1 nM to 10 nM, 1 nM to 5 nM, 5 nM to 100 nM, 5 nM to 10 nM, or 10 nM to 100 nM, for binding to mammalian CD71.

In some embodiments, the activatable antibody includes an antibody or antigen-binding fragment thereof (AB) that specifically binds CD71. In some embodiments, the antibody or antigen-binding fragment thereof that binds CD71 is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, such an antibody or antigen-binding fragment thereof that binds CD71 is a mouse, other rodent, chimeric, humanized or fully human monoclonal antibody.

In some embodiments, the activatable antibody in an uncleaved state specifically binds to the mammalian CD71 with a dissociation constant less than or equal to 1 nM, less than or equal to 5 nM, less than or equal to 10 nM, less than or equal to 15 nM, less than or equal to 20 nM, less than or equal to 25 nM, less than or equal to 50 nM, less than or equal to 100 nM, less than or equal to 150 nM, less than or equal to 250 nM, less than or equal to 500 nM, less than or equal to 750 nM, less than or equal to 1000 nM, and/or less than or equal to 2000 nM.

In some embodiments, the activatable antibody in an uncleaved state specifically binds to the mammalian CD71 with a dissociation constant in the range of 1 nM to 2000 nM, 1 nM to 1000 nM, 1 nM to 750 nM, 1 nM to 500 nM, 1 nM to 250 nM, 1 nM to 150 nM, 1 nM to 100 nM, 1 nM to 50 nM, 1 nM to 25 nM, 1 nM to 15 nM, 1 nM to 10 nM, 1 nM to 5 nM, 5 nM to 2000 nM, 5 nM to 1000 nM, 5 nM to 750 nM, 5 nM to 500 nM, 5 nM to 250 nM, 5 nM to 150 nM, 5 nM to 100 nM, 5 nM to 50 nM, 5 nM to 25 nM, 5 nM to 15 nM, 5 nM to 10 nM, 10 nM to 2000 nM, 10 nM to 1000 nM, 10 nM to 750 nM, 10 nM to 500 nM, 10 nM to 250 nM, 10 nM to 150 nM, 10 nM to 100 nM, 10 nM to 50 nM, 10 nM to 25 nM, 10 nM to 15 nM, 15 nM to 2000 nM, 15 nM to 1000 nM, 15 nM to 750 nM, 15 nM to 500 nM, 15 nM to 250 nM, 15 nM to 150 nM, 15 nM to 100 nM, 15 nM to 50 nM, 15 nM to 25 nM, 25 nM to 2000 nM, 25 nM to 1000 nM, 25 nM to 750 nM, 25 nM to 500 nM, 25 nM to 250 nM, 25 nM to 150 nM, 25 nM to 100 nM, 25 nM to 50 nM, 50 nM to 2000 nM, 50 nM to 1000 nM, 50 nM to 750 nM, 50 nM to 500 nM, 50 nM to 250 nM, 50 nM to 150 nM, 50 nM to 100 nM, 100 nM to 2000 nM, 100 nM to 1000 nM, 100 nM to 750 nM, 100 nM to 500 nM, 100 nM to 250 nM, 100 nM to 150 nM, 150 nM to 2000 nM, 150 nM to 1000 nM, 150 nM to 750 nM, 150 nM to 500 nM, 150 nM to 250 nM, 250 nM to 2000 nM, 250 nM to 1000 nM, 250 nM to 750 nM, 250 nM to 500 nM, 500 nM to 2000 nM, 500 nM to 1000 nM, 500 nM to 750 nM, 500 nM to 500 nM, 500 nM to 250 nM, 500 nM to 150 nM, 500 nM to 100 nM, 500 nM to 50 nM, 750 nM to 2000 nM, 750 nM to 1000 nM, or 1000 nM to 2000 nM.

In some embodiments, the activatable antibody in an activated state specifically binds to the mammalian CD71 with a dissociation constant is less than or equal to 0.01 nM, 0.05 nM, 0.1 nM, 0.5 nM, 1 nM, 5 nM, or 10 nM.

In some embodiments, the activatable antibody in an activated state specifically binds to the mammalian CD71 with a dissociation constant in the range of 0.01 nM to 100 nM, 0.01 nM to 10 nM, 0.01 nM to 5 nM, 0.01 nM to 1 nM, 0.01 to 0.5 nM, 0.01 nm to 0.1 nM, 0.01 nm to 0.05 nM, 0.05 nM to 100 nM, 0.05 nM to 10 nM, 0.05 nM to 5 nM, 0.05 nM to 1 nM, 0.05 to 0.5 nM, 0.05 nm to 0.1 nM, 0.1 nM to 100 nM, 0.1 nM to 10 nM, 0.1 nM to 5 nM, 0.1 nM to 1 nM, 0.1 to 0.5 nM, 0.5 nM to 100 nM, 0.5 nM to 10 nM, 0.5 nM to 5 nM, 0.5 nM to 1 nM, 1 nM to 100 nM, 1 nM to 10 nM, 1 nM to 5 nM, 5 nM to 100 nM, 5 nM to 10 nM, or 10 nM to 100 nM.

In some embodiments, the mammalian CD71 is selected from the group consisting of a human CD71, a murine CD71, a rat CD71, and a cynomolgus monkey CD71. In some embodiments, the AB specifically binds to human CD71, murine CD71 or cynomolgus monkey CD71 with a dissociation constant of less than 1 nM. In some embodiments, the mammalian CD71 is a human CD71.

In some embodiments, the AB has one or more of the following characteristics: (a) the AB specifically binds to human CD71; and (b) the AB specifically binds to human CD71 and cynomolgus monkey CD71.

In some embodiments, the AB has one or more of the following characteristics: (a) the AB specifically binds human CD71 and cynomolgus monkey CD71; (b) the AB inhibits binding of transferrin to mammalian CD71; (c) the AB inhibits binding of human transferrin to human CD71; and (d) the AB inhibits binding of cynomolgus monkey transferrin to cynomolgus monkey CD71.

In some embodiments, the AB blocks the ability of a natural ligand to bind to the mammalian CD71 with an EC$_{50}$ less than or equal to 5 nM, less than or equal to 10 nM, less than or equal to 50 nM, less than or equal to 100 nM, less than or equal to 500 nM, and/or less than or equal to 1000 nM. In some embodiments, the AB blocks the ability of a transferrin to bind to the mammalian CD71 with an EC$_{50}$ less than or equal to 5 nM, less than or equal to 10 nM, less than or equal to 50 nM, less than or equal to 100 nM, less than or equal to 500 nM, and/or less than or equal to 1000 nM. In some embodiments, the natural ligand of CD71 is transferrin.

In some embodiments, the AB blocks the ability of a natural ligand to bind to the mammalian CD71 with an EC$_{50}$ of 5 nM to 1000 nM, 5 nM to 500 nM, 5 nM to 100 nM 5 nM to 50 nM, 5 nM to 10 nM, 10 nM to 1000 nM, 10 nM to 500 nM, 10 nM to 100 nM 10 nM to 50 nM, 50 nM to 1000 nM, 50 nM to 500 nM, 50 nM to 100 nM, 50 nM to 1000 nM, 100 nM to 500 nM, 500 nM to 1000 nM. In some embodiments, the AB blocks the ability of a transferrin to bind to the mammalian CD71 with an $EC_{50}$ of 5 nM to 1000 nM, 5 nM to 500 nM, 5 nM to 100 nM 5 nM to 50 nM, 5 nM to 10 nM, 10 nM to 1000 nM, 10 nM to 500 nM, 10 nM to 100 nM 10 nM to 50 nM, 50 nM to 1000 nM, 50 nM to 500 nM, 50 nM to 100 nM, 100 nM to 1000 nM, 100 nM to 500 nM, 500 nM to 1000 nM. In some embodiments, the natural ligand of CD71 is transferrin.

In some embodiments, the AB of the present disclosure inhibits or reduces the growth, proliferation, and/or metastasis of cells expressing mammalian CD71. Without intending to be bound by any theory, the AB of the present disclosure may inhibit or reduce the growth, proliferation, and/or metastasis of cells expressing mammalian CD71 by specifically binding to CD71 and inhibiting, blocking, and/or preventing the binding of a natural ligand to mammalian CD71. In some embodiments, the natural ligand of mammalian CD71 is transferrin.

In some embodiments, the activatable antibody comprises a heavy chain variable region amino acid sequence selected from the group consisting of SEQ ID NO: 1, and 3-5. In some embodiments, the activatable antibody comprises a heavy chain variable region amino acid sequence selected from the group consisting of SEQ ID NO: 3-5.

In some embodiments, the activatable antibody comprises a light chain variable region amino acid sequence selected from the group consisting of SEQ ID NO: 2 and 6-8. In some embodiments, the activatable antibody comprises a light chain variable region amino acid sequence selected from the group consisting of SEQ ID NO: 6-8.

In some embodiments, the activatable antibody comprises a heavy chain variable region amino acid sequence selected from the group consisting of SEQ ID NO: 1 and 3-5, and a light chain variable region amino acid sequence selected from the group consisting of SEQ ID NO: 2 and 6-8.

In some embodiments, the activatable antibody comprises a heavy chain variable region amino acid sequence selected from the group consisting of SEQ ID NO: 3-5, and a light chain variable region amino acid sequence selected from the group consisting of SEQ ID NO: 6-8.

In some embodiments, the activatable antibody comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 1 and 3-5. In some embodiments, the activatable antibody comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 3-5.

In some embodiments, the activatable antibody comprises a light chain variable region amino acid sequence that is at least 90%, 91%, 92%, 93%, 94%, 95%, 96%, 97%, 98% or 99% identical to an amino acid sequence selected from the group consisting of SEQ ID NO: 2 and 6-8. In some embodiments, the activatable antibody comprises a light chain variable region amino acid sequence that is at least 90%, 91%, 92%, 93%, 94%, 95%, 96%, 97%, 98% or 99% identical to an amino acid sequence selected from the group consisting of SEQ ID NO: 6-8.

In some embodiments, the activatable antibody comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 1 and 3-5, and a light chain variable region amino acid sequence that is at least 90%, 91%, 92%, 93%, 94%, 95%, 96%, 97%, 98% or 99% identical to an amino acid sequence selected from the group consisting of SEQ ID NO: 2 and 6-8.

In some embodiments, the activatable antibody comprises a heavy chain variable region amino acid sequence that is at least 90%, 91%, 92%, 93%, 94%, 95%, 96%, 97%, 98% or 99% identical to an amino acid sequence selected from the group consisting of SEQ ID NO: 3-5, and a light chain variable region amino acid sequence that is at least 90%, 91%, 92%, 93%, 94%, 95%, 96%, 97%, 98% or 99% identical to an amino acid sequence selected from the group consisting of SEQ ID NO: 6-8.

In some embodiments, the activatable antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence comprising the amino acid sequence GYTFTSYWMH (SEQ ID NO: 9); a VH CDR2 sequence that includes a sequence that is at least 90%, 91%, 92%, 93%, 94%, 95%, 96%, 97%, 98%, 99% or more identical to a VH CDR2 sequence comprising the amino acid sequence AIYPGNSETG (SEQ ID NO: 10); a VH CDR3 sequence that includes a sequence that is at least 90%, 91%, 92%, 93%, 94%, 95%, 96%, 97%, 98%, 99% or more identical to a VH CDR3 sequence comprising the amino acid sequence ENWDPGFAF (SEQ ID NO: 11); a VL CDR1 sequence that includes a sequence that is at least 90%, 91%, 92%, 93%, 94%, 95%, 96%, 97%, 98%, 99% or more identical to a VL CDR1 sequence comprising the amino acid sequence SASSSVYMY (SEQ ID NO: 12) or CRASSSVYYMY (SEQ ID NO: 13); a VL CDR2 sequence that includes a sequence that is at least 90%, 91%, 92%, 93%, 94%, 95%, 96%, 97%, 98%, 99% or more identical to a VL CDR2 sequence comprising the amino acid sequence STSNLAS (SEQ ID NO: 14; and a VL CDR3 sequence that includes a sequence that is at least 90%, 91%, 92%, 93%, 94%, 95%, 96%, 97%, 98%, 99% or more identical to a VL CDR3 sequence comprising the amino acid sequence QQRRNYPYT (SEQ ID NO: 15).

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises the amino acid sequence GYTFTSYWMH (SEQ ID NO: 9); the VH CDR2 sequence comprises the amino acid sequence AIYPGNSETG (SEQ ID NO: 10); the VH CDR3 sequence comprises the amino acid sequence ENWDPGFAF (SEQ ID NO: 11); the VL CDR1 sequence comprises the amino acid sequence SASSSVYYMY (SEQ ID NO: 12) or CRASSSVYYMY (SEQ ID NO: 13); the VL CDR2 sequence comprises the amino acid sequence STSNLAS (SEQ ID NO: 14); and the VL CDR3 sequence comprises the amino acid sequence QQRRNYPYT (SEQ ID NO: 15).

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to the amino acid sequence GYTFTSYWMH (SEQ ID NO: 9); the VH CDR2 sequence comprises a sequence that is at least 90%, 91%, 92%, 93%, 94%, 95%, 96%, 97%, 98%, 99% or more identical to the amino acid sequence AIYPGNSETG (SEQ ID NO: 10); the VH CDR3 sequence comprises a sequence that is at least 90%, 91%, 92%, 93%, 94%, 95%, 96%, 97%, 98%, 99% or more identical to the amino acid sequence ENWDPGFAF (SEQ ID NO: 11); the VL CDR1 sequence comprises a sequence that is at least 90%, 91%, 92%, 93%, 94%, 95%, 96%, 97%, 98%, 99% or more identical to the amino acid sequence SASSSVYYMY (SEQ ID NO: 12) or CRASSSVYYMY (SEQ ID NO: 13); the VL CDR2 sequence comprises a sequence that is at least 90%, 91%, 92%, 93%, 94%, 95%, 96%, 97%, 98%, 99% or more identical to the amino acid sequence STSNLAS (SEQ ID NO: 14); and the VL CDR3 sequence comprises a sequence that is at least 90%, 91%, 92%, 93%, 94%, 95%, 96%, 97%, 98%, 99 or more identical to the amino acid sequence QQRRNYPYT (SEQ ID NO: 15).

In some embodiments, the AB of the activatable anti-CD71 antibody comprises a heavy chain variable region amino acid sequence selected from the group consisting of the heavy chain variable region sequences shown in Table 12. In some embodiments, the AB of the activatable anti-CD71 antibody comprises a light chain variable region amino acid sequence selected from the group consisting of the light chain variable region sequences shown in Table 12. In some embodiments, the AB of the activatable anti-CD71 antibody comprises a heavy chain variable region amino acid sequence selected from the group consisting of the heavy chain variable region sequences shown in Table 12 and a light chain variable region amino acid sequence selected from the group consisting of the light chain variable region sequences shown in Table 12.

In some embodiments, the AB of the activatable anti-CD71 antibody comprises a heavy chain variable region amino acid sequence that is at least 90%, 91%, 92%, 93%, 94%, 95%, 96%, 97%, 98% or 99% identical to an amino acid sequence selected from the group consisting of the heavy chain variable region sequences shown in Table 12. In some embodiments, the AB of the activatable anti-CD71 antibody comprises a light chain variable region amino acid sequence that is at least 90%, 91%, 92%, 93%, 94%, 95%, 96%, 97%, 98% or 99%, identical to an amino acid sequence selected from the group consisting of the light chain variable region sequences shown in Table 12. In some embodiments, the AB of the activatable anti-CD71 antibody comprises a heavy chain variable region amino acid sequence that is at least 90%, 91%, 92%, 93%, 94%, 95%, 96%, 97%, 98% or 99% identical to an amino acid sequence selected from the group consisting of the heavy chain variable region sequences shown in Table 12 and a light chain variable region amino acid sequence that is at least 90%, 91%, 92%, 93%, 94%, 95%, 96%, 97%, 98% or 99% identical to an amino acid sequence selected from the group consisting of the light chain variable region sequences shown in Table 12.

In some embodiments, the activatable antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 13, a VH CDR2 sequence shown in Table 13; a VH CDR3 sequence shown in Table 13; a VL CDR1 sequence shown in Table 13; a VL CDR2 sequence shown in Table 13; and a VL CDR3 sequence shown in Table 13.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 13; a VH CDR2 sequence that includes a sequence that is at least 90%, 91%, 92%, 93%, 94%, 95%, 96%, 97%, 98%, 99% or more identical to a VH CDR2 sequence shown in Table 13; a VH CDR3 sequence that includes a sequence that is at least 90%, 91%, 92%, 93%, 94%, 95%, 96%, 97%, 98%, 99% or more identical to a VH CDR3 sequence shown in Table 13; a VL CDR1 sequence that includes a sequence that is at least 90%, 91%, 92%, 93%, 94%, 95%, 96%, 97%, 98%, 99% or more identical to a VL CDR1 sequence shown in Table 13; a VL CDR2 sequence that includes a sequence that is at least 90%, 91%, 92%, 93%, 94%, 95%, 96%, 97%, 98%, 99% or more identical to a VL CDR2 sequence shown in Table 13; and a VL CDR3 sequence that includes a sequence that is at least 90%, 91%, 92%, 93%, 94%, 95%, 96%, 97%, 98%, 99% or more identical to a VL CDR3 sequence shown in Table 13.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 13.

In some embodiments, the activatable antibody comprises a heavy chain that comprises a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 13.

In some embodiments, the activatable antibody comprises a light chain that comprises a combination of a VL CDR1 sequence, a VL CDR2 sequence, and a VL CDR3 sequence, wherein the combination is a combination of the three light chain CDR sequences (VL CDR1, VL CDR2, VL CDR3) shown in a single row in Table 13.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the six CDR sequences (VH CDR1, VH CDR2, VH CDR3, VL CDR1, VL CDR2, and VL CDR3) shown in a single row in Table 13.

In some embodiments, the activatable antibody comprises a heavy chain variable region that comprises a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 13.

In some embodiments, the activatable antibody comprises a light chain variable region that comprises a combination of a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three light chain CDR sequences (VL CDR1, VL CDR2, VL CDR3) shown in a single row in Table 13.

In some embodiments, the MM has a dissociation constant for binding to the AB which is greater than the dissociation constant of the AB to CD71.

In some embodiments, the MM has a dissociation constant for binding to the AB which is no more than the dissociation constant of the AB to CD71.

In some embodiments, the MM has a dissociation constant for binding to the AB which is less than the dissociation constant of the AB to CD71.

In some embodiments, the dissociation constant ($K_d$) of the MM towards the AB is no more than 2, 3, 4, 5, 10, 25, 50, 100, 250, 500, 1,000, 2,500, 5,000, 10,000, 50,000, 100,000, 500,000, 1,000,000, 5,000,000, 10,000,000, 50,000,000 times or greater, or between 1-5, 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times or greater than the dissociation constant of the AB towards the target.

In some embodiments, the MM does not interfere or compete with the AB for binding to CD71 when the activatable antibody is in a cleaved state.

In some embodiments, the MM is a polypeptide of about 2 to 40 amino acids in length. In some embodiments, the MM is a polypeptide of up to about 40 amino acids in length.

In some embodiments, the MM polypeptide sequence is different from that of CD71. In some embodiments, the MM polypeptide sequence is no more than 50% identical to any natural binding partner of the AB. In some embodiments, the MM polypeptide sequence is different from that of CD71 and is no more than 40%, 30%, 25%, 20%, 15%, or 10% identical to any natural binding partner of the AB.

In some embodiments, the coupling of the MM to the AB reduces the ability of the AB to bind CD71 such that the dissociation constant ($K_d$) of the AB when coupled to the MM towards CD71 is at least two times greater than the $K_d$ of the AB when not coupled to the MM towards CD71.

In some embodiments, the coupling of the MM to the AB reduces the ability of the AB to bind CD71 such that the dissociation constant ($K_d$) of the AB when coupled to the MM towards CD71 is at least five times greater than the $K_d$ of the AB when not coupled to the MM towards CD71.

In some embodiments, the coupling of the MM to the AB reduces the ability of the AB to bind CD71 such that the dissociation constant ($K_d$) of the AB when coupled to the MM towards CD71 is at least 10 times greater than the $K_d$ of the AB when not coupled to the MM towards CD71.

In some embodiments, the coupling of the MM to the AB reduces the ability of the AB to bind CD71 such that the dissociation constant ($K_d$) of the AB when coupled to the MM towards CD71 is at least 20 times greater than the $K_d$ of the AB when not coupled to the MM towards CD71.

In some embodiments, the coupling of the MM to the AB reduces the ability of the AB to bind CD71 such that the dissociation constant ($K_d$) of the AB when coupled to the MM towards CD71 is at least 40 times greater than the $K_d$ of the AB when not coupled to the MM towards CD71.

In some embodiments, the coupling of the MM to the AB reduces the ability of the AB to bind CD71 such that the dissociation constant ($K_d$) of the AB when coupled to the MM towards CD71 is at least 100 times greater than the $K_d$ of the AB when not coupled to the MM towards CD71.

In some embodiments, the coupling of the MM to the AB reduces the ability of the AB to bind CD71 such that the dissociation constant ($K_d$) of the AB when coupled to the MM towards CD71 is at least 1000 times greater than the $K_d$ of the AB when not coupled to the MM towards CD71.

In some embodiments, the coupling of the MM to the AB reduces the ability of the AB to bind CD71 such that the dissociation constant ($K_d$) of the AB when coupled to the MM towards CD71 is at least 10,000 times greater than the $K_d$ of the AB when not coupled to the MM towards CD71.

In some embodiments, in the presence of CD71, the MM reduces the ability of the AB to bind CD71 by at least 90% when the CM is uncleaved, as compared to when the CM is cleaved when assayed in vitro using a target displacement assay such as, for example, the assay described in PCT Publication No. WO 2010/081173, the contents of which are hereby incorporated by reference in their entirety.

In some embodiments, MM comprises an amino acid sequence selected from the group consisting of SEQ ID NO: 16-295 and 297-314.

In some embodiments, the protease that cleaves the CM is active, e.g., up-regulated or otherwise unregulated, in diseased tissue, and the protease cleaves the CM in the activatable antibody when the activatable antibody is exposed to the protease.

In some embodiments, the protease is co-localized with CD71 in a tissue, and the protease cleaves the CM in the activatable antibody when the activatable antibody is exposed to the protease.

In some embodiments, the CM is positioned in the activatable antibody such that when the activatable antibody is in the uncleaved state, binding of the activatable antibody to CD71 is reduced to occur with a dissociation constant that is at least twofold greater than the dissociation constant of an unmodified AB binding to CD71, whereas in the cleaved state (i.e., when the activatable antibody is in the cleaved state), the AB binds CD71.

In some embodiments, the CM is positioned in the activatable antibody such that when the activatable antibody is in the uncleaved state, binding of the activatable antibody to CD71 is reduced to occur with a dissociation constant that is at least fivefold greater than the dissociation constant of an unmodified AB binding to CD71, whereas in the cleaved state (i.e., when the activatable antibody is in the cleaved state), the AB binds CD71.

In some embodiments, the CM is positioned in the activatable antibody such that when the activatable antibody is in the uncleaved state, binding of the activatable antibody to CD71 is reduced to occur with a dissociation constant that is at least 10-fold greater than the dissociation constant of an unmodified AB binding to CD71, whereas in the cleaved state (i.e., when the activatable antibody is in the cleaved state), the AB binds CD71.

In some embodiments, the CM is positioned in the activatable antibody such that when the activatable antibody is in the uncleaved state, binding of the activatable antibody to CD71 is reduced to occur with a dissociation constant that is at least 20-fold greater than the dissociation constant of an unmodified AB binding to CD71, whereas in the cleaved state (i.e., when the activatable antibody is in the cleaved state), the AB binds CD71.

In some embodiments, the CM is positioned in the activatable antibody such that when the activatable antibody is in the uncleaved state, binding of the activatable antibody to CD71 is reduced to occur with a dissociation constant that is at least 40-fold greater than the dissociation constant of an unmodified AB binding to CD71, whereas in the cleaved state, the AB binds CD71.

In some embodiments, the CM is positioned in the activatable antibody such that when the activatable antibody is in the uncleaved state, binding of the activatable antibody to CD71 is reduced to occur with a dissociation constant that is at least 50-fold greater than the dissociation constant of an unmodified AB binding to CD71, whereas in the cleaved state, the AB binds CD71.

In some embodiments, the CM is positioned in the activatable antibody such that when the activatable antibody is in the uncleaved state, binding of the activatable antibody to CD71 is reduced to occur with a dissociation constant that is at least 100-fold greater than the dissociation constant of an unmodified AB binding to CD71, whereas in the cleaved state, the AB binds CD71.

In some embodiments, the CM is positioned in the activatable antibody such that when the activatable antibody is in the uncleaved state, binding of the activatable antibody to CD71 is reduced to occur with a dissociation constant that is at least 200-fold greater than the dissociation constant of an unmodified AB binding to CD71, whereas in the cleaved state, the AB binds CD71.

In some embodiments, the CM is a polypeptide of up to 15 amino acids in length.

In some embodiments, the CM is a polypeptide that includes a first cleavable moiety (CM1) that is a substrate for at least one matrix metalloprotease (MMP) and a second cleavable moiety (CM2) that is a substrate for at least one serine protease (SP). In some embodiments, each of the CM1 substrate sequence and the CM2 substrate sequence of the CM1-CM2 substrate is independently a polypeptide of up to 15 amino acids in length.

In some embodiments, the CM is a substrate for at least one protease that is or is believed to be up-regulated or otherwise unregulated in cancer.

In some embodiments, the CM is a substrate for at least one protease selected from the group consisting of a matrix metalloprotease (MMP), thrombin, a neutrophil elastase, a cysteine protease, legumain, and a serine protease, such as matriptase (MT-SP1), and urokinase (uPA). Without being bound by theory, it is believed that these proteases are up-regulated or otherwise unregulated in at least one of cancer.

Exemplary substrates include but are not limited to substrates cleavable by one or more of the following enzymes or proteases listed in Table 4.

In some embodiments, the CM is selected for use with a specific protease, for example a protease that is known to be co-localized with the target of the activatable antibody.

In some embodiments, the CM is a substrate for at least one MMP. Examples of MMPs include the MMPs listed in the Table 4. In some embodiments, the CM is a substrate for a protease selected from the group consisting of MMP 9, MMP14, MMP1, MMP3, MMP13, MMP17, MMP11, and MMP19. In some embodiments the CM is a substrate for MMP9. In some embodiments, the CM is a substrate for MMP14.

In some embodiments, the CM is a substrate that includes the sequence TGRGPSWV (SEQ ID NO: 356); SARGPSRW (SEQ ID NO: 357); TARGPSFK (SEQ ID NO: 358); LSGRSDNH (SEQ ID NO: 359); GGWHTGRN (SEQ ID NO: 360); HTGRSGAL (SEQ ID NO: 361); PLTGRSGG (SEQ ID NO: 362); AARGPAIH (SEQ ID NO: 363); RGPAFNPM (SEQ ID NO: 364); SSRGPAYL (SEQ ID NO: 365); RGPATPIM (SEQ ID NO: 366); RGPA (SEQ ID NO: 367); GGQPSGMWGW (SEQ ID NO: 368); FPRPLGITGL (SEQ ID NO: 369); VHMPLGFLGP (SEQ ID NO: 370); SPLTGRSG (SEQ ID NO: 371); SAGFSLPA (SEQ ID NO: 372); LAPLGLQRR (SEQ ID NO: 373); SGGPLGVR (SEQ ID NO: 374); PLGL (SEQ ID NO: 375); LSGRSGNH (SEQ ID NO: 789); SGRSANPRG (SEQ ID NO: 790); LSGRSDDH (SEQ ID NO: 791); LSGRSDIH (SEQ ID NO: 792); LSGRSDQH (SEQ ID NO: 793); LSGRSDTH (SEQ ID NO: 794); LSGRSDYH (SEQ ID NO: 795); LSGRSDNP (SEQ ID NO: 796); LSGRSANP (SEQ ID NO: 797); LSGRSANI (SEQ ID NO: 798); LSGRSDNI (SEQ ID NO: 799); MIAPVAYR (SEQ ID NO: 800); RPSPMWAY (SEQ ID NO: 801); WATPRPMR (SEQ ID NO: 802); FRLLDWQW (SEQ ID NO: 803); ISSGL (SEQ ID NO: 804); ISSGLLS (SEQ ID NO: 805); and/or ISSGLL (SEQ ID NO: 806).

In some embodiments, the CM comprises the amino acid sequence LSGRSDNH (SEQ ID NO: 359). In some embodiments, the CM comprises the amino acid sequence TGRGPSWV (SEQ ID NO: 356). In some embodiments, the CM comprises the amino acid sequence PLTGRSGG (SEQ ID NO: 362). In some embodiments, the CM comprises the amino acid sequence GGQPSGMWGW (SEQ ID NO: 368). In some embodiments, the CM comprises the amino acid sequence FPRPLGITGL (SEQ ID NO: 369). In some embodiments, the CM comprises the amino acid sequence VHMPLGFLGP (SEQ ID NO: 370). In some embodiments, the CM comprises the amino acid sequence PLGL (SEQ ID NO: 375). In some embodiments, the CM comprises the amino acid sequence SARGPSRW (SEQ ID NO: 357). In some embodiments, the CM comprises the amino acid sequence TARGPSFK (SEQ ID NO: 358). In some embodiments, the CM comprises the amino acid sequence GGWHTGRN (SEQ ID NO: 360). In some embodiments, the CM comprises the amino acid sequence HTGRSGAL (SEQ ID NO: 361). In some embodiments, the CM comprises the amino acid sequence AARGPAIH (SEQ ID NO: 363). In some embodiments, the CM comprises the amino acid sequence RGPAFNPM (SEQ ID NO: 364). In some embodiments, the CM comprises the amino acid sequence SSRGPAYL (SEQ ID NO: 365). In some embodiments, the CM comprises the amino acid sequence RGPATPIM (SEQ ID NO: 366). In some embodiments, the CM comprises the amino acid sequence RGPA (SEQ ID NO: 367). In some embodiments, the CM comprises the amino acid sequence LSGRSGNH (SEQ ID NO: 789). In some embodiments, the CM comprises the amino acid sequence SGRSANPRG (SEQ ID NO: 790). In some embodiments, the CM comprises the amino acid sequence LSGRSDDH (SEQ ID NO: 791). In some embodiments, the CM comprises the amino acid sequence LSGRSDIH (SEQ ID NO: 792). In some embodiments, the CM comprises the amino acid sequence LSGRSDQH (SEQ ID NO: 793). In some embodiments, the CM comprises the amino acid sequence LSGRSDTH (SEQ ID NO: 794). In some embodiments, the CM comprises the amino acid sequence LSGRSDYH (SEQ ID NO: 795). In some embodiments, the CM comprises the amino acid sequence LSGRSDNP (SEQ ID NO: 796). In some embodiments, the CM comprises the amino acid sequence LSGRSANP (SEQ ID NO: 797). In some embodiments, the CM comprises the amino acid sequence LSGRSANI (SEQ ID NO: 798). In some embodiments, the CM comprises the amino acid sequence LSGRSDNI (SEQ ID NO: 799). In some embodiments, the CM comprises the amino acid sequence MIAPVAYR (SEQ ID NO: 800). In some embodiments, the CM comprises the amino acid sequence RPSPMWAY (SEQ ID NO: 801). In some embodiments, the CM comprises the amino acid sequence WATPRPMR (SEQ ID NO: 802). In some embodiments, the CM comprises the amino acid sequence FRLLDWQW (SEQ ID NO: 803). In some embodiments, the CM comprises the amino acid sequence ISSGL (SEQ ID NO: 804). In some embodiments, the CM comprises the amino acid sequence ISSGLLS (SEQ ID NO: 805). In some embodiments, the CM comprises the amino acid sequence and/or ISSGLL (SEQ ID NO: 806).

In some embodiments, the CM is a substrate for an MMP and includes the sequence ISSGLSS (SEQ ID NO: 376); QNQALRMA (SEQ ID NO: 377); AQNLLGMV (SEQ ID NO: 378); STFPFGMF (SEQ ID NO: 379); PVGYTSSL (SEQ ID NO: 380); DWLYWPGI (SEQ ID NO: 381), ISSGLLSS (SEQ ID NO: 382), LKAAPRWA (SEQ ID NO: 383); GPSHLVLT (SEQ ID NO: 384); LPGGLSPW (SEQ ID NO: 385); MGLFSEAG (SEQ ID NO: 386); SPLPLRVP (SEQ ID NO: 387); RMHLRSLG (SEQ ID NO: 388); LAAPLGLL (SEQ ID NO: 389); AVGLLAPP (SEQ ID NO: 390); LLAPSHRA (SEQ ID NO: 391); and/or PAGLWLDP (SEQ ID NO: 392).

In some embodiments, the CM comprises the amino acid sequence ISSGLSS (SEQ ID NO: 376). In some embodiments, the CM comprises the amino acid sequence QNQALRMA (SEQ ID NO: 377). In some embodiments, the CM comprises the amino acid sequence AQNLLGMV (SEQ ID NO: 378). In some embodiments, the CM comprises the amino acid sequence STFPFGMF (SEQ ID NO: 379). In some embodiments, the CM comprises the amino acid sequence PVGYTSSL (SEQ ID NO: 380). In some embodiments, the CM comprises the amino acid sequence DWLYWPGI (SEQ ID NO: 381). In some embodiments, the CM comprises the amino acid sequence ISSGLLSS (SEQ ID NO: 382). In some embodiments, the CM comprises the amino acid sequence LKAAPRWA (SEQ ID NO: 383). In some embodiments, the CM comprises the amino acid sequence GPSHLVLT (SEQ ID NO: 384). In some embodiments, the CM comprises the amino acid sequence LPGGLSPW (SEQ ID NO: 385). In some embodiments, the CM comprises the amino acid sequence MGLFSEAG (SEQ ID NO: 386). In some embodiments, the CM comprises the amino acid sequence SPLPLRVP (SEQ ID NO: 387). In some embodiments, the CM comprises the amino acid sequence RMHLRSLG (SEQ ID NO: 388). In some embodiments, the CM comprises the amino acid sequence LAAPLGLL (SEQ ID NO: 389). In some embodiments, the CM comprises the amino acid sequence AVGLLAPP (SEQ ID NO: 390). In some embodiments, the CM comprises the amino acid sequence LLAPSHRA (SEQ ID NO: 391). In some embodiments, the CM comprises the amino acid sequence PAGLWLDP (SEQ ID NO: 392).

In some embodiments, the CM is a substrate for thrombin. In some embodiments, the CM is a substrate for thrombin and includes the sequence GPRSFGL (SEQ ID NO: 393) or GPRSFG (SEQ ID NO: 394). In some embodiments, the CM comprises the amino acid sequence GPRSFGL (SEQ ID NO: 393). In some embodiments, the CM comprises the amino acid sequence GPRSFG (SEQ ID NO: 394).

In some embodiments, the CM comprises an amino acid sequence selected from the group consisting of NTLSGRSENHSG (SEQ ID NO: 395); NTLSGRSGNHGS (SEQ ID NO: 396); TSTSGRSANPRG (SEQ ID NO: 397); TSGRSANP (SEQ ID NO: 398); VAGRSMRP (SEQ ID NO: 399); VVPEGRRS (SEQ ID NO: 400); ILPRSPAF (SEQ ID NO: 401); MVLGRSLL (SEQ ID NO: 402); QGRAITFI (SEQ ID NO: 403); SPRSIMLA (SEQ ID NO: 404); and SMLRSMPL (SEQ ID NO: 405).

In some embodiments, the CM comprises the amino acid sequence NTLSGRSENHSG (SEQ ID NO: 395). In some embodiments, the CM comprises the amino acid sequence NTLSGRSGNHGS (SEQ ID NO: 396). In some embodiments, the CM comprises the amino acid sequence TSTSGRSANPRG (SEQ ID NO: 397). In some embodiments, the CM comprises the amino acid sequence TSGRSANP (SEQ ID NO: 398). In some embodiments, the CM comprises the amino acid sequence VAGRSMRP (SEQ ID NO: 399). In some embodiments, the CM comprises the amino acid sequence VVPEGRRS (SEQ ID NO: 400). In some embodiments, the CM comprises the amino acid sequence ILPRSPAF (SEQ ID NO: 401). In some embodiments, the CM comprises the amino acid sequence MVLGRSLL (SEQ ID NO: 402). In some embodiments, the CM comprises the amino acid sequence QGRAITFI (SEQ ID NO: 403). In some embodiments, the CM comprises the amino acid sequence SPRSIMLA (SEQ ID NO: 404). In some embodiments, the CM comprises the amino acid sequence SMLRSMPL (SEQ ID NO: 405).

In some embodiments, the CM is a substrate for a neutrophil elastase. In some embodiments, the CM is a substrate for a serine protease. In some embodiments, the CM is a substrate for uPA. In some embodiments, the CM is a substrate for legumain. In some embodiments, the CM is a substrate for matriptase. In some embodiments, the CM is a substrate for a cysteine protease. In some embodiments, the CM is a substrate for a cysteine protease, such as a cathepsin.

In some embodiments, the CM is a CM1-CM2 substrate and includes the sequence ISSGLLSGRSDNH (SEQ ID NO: 406); ISSGLLSSGGSGGSLSGRSDNH (SEQ ID NO:

407); AVGLLAPPGGTSTSGRSANPRG (SEQ ID NO: 408); TSTSGRSANPRGGGAVGLLAPP (SEQ ID NO: 409); VHMPLGFLGPGGTSTSGRSANPRG (SEQ ID NO: 410); TSTSGRSANPRGGGVHMPLGFLGP (SEQ ID NO: 411); AVGLLAPPGGLSGRSDNH (SEQ ID NO: 412); LSGRSDNHGGAVGLLAPP (SEQ ID NO: 413); VHMPL-GFLGPGGLSGRSDNH (SEQ ID NO: 414); LSGRSDN-HGGVHMPLGFLGP (SEQ ID NO: 415); LSGRSDN-HGGSGGSISSGLLSS (SEQ ID NO: 416); LSGRSGNHGGSGGSISSGLLSS (SEQ ID NO: 417); ISS-GLLSSGGSGGSLSGRSGNH (SEQ ID NO: 418); LSGRS-DNHGGSGGSQNQALRMA (SEQ ID NO: 419); QNQAL-RMAGGSGGSLSGRSDNH (SEQ ID NO: 420); LSGRSGNHGGSGGSQNQALRMA (SEQ ID NO: 421); QNQALRMAGGSGGSLSGRSGNH (SEQ ID NO: 422); ISSGLLSGRSGNH (SEQ ID NO: 423); ISSGLLSGRSAN-PRG (SEQ ID NO: 680); AVGLLAPPTSGRSANPRG (SEQ ID NO: 681); AVGLLAPPSGRSANPRG (SEQ ID NO: 682); ISSGLLSGRSDDH (SEQ ID NO: 683); ISS-GLLSGRSDIH (SEQ ID NO: 684); ISSGLLSGRSDQH (SEQ ID NO: 685); ISSGLLSGRSDTH (SEQ ID NO: 686); ISSGLLSGRSDYH (SEQ ID NO: 687); ISSGLLSGRS-DNP (SEQ ID NO: 688); ISSGLLSGRSANP (SEQ ID NO: 689); ISSGLLSGRSANI (SEQ ID NO: 690); AVGLLAP-PGGLSGRSDDH (SEQ ID NO: 691); AVGLLAPPGGLS-GRSDIH (SEQ ID NO: 692); AVGLLAPPGGLSGRSDQH (SEQ ID NO: 693); AVGLLAPPGGLSGRSDTH (SEQ ID NO: 694); AVGLLAPPGGLSGRSDYH (SEQ ID NO: 695); AVGLLAPPGGLSGRSDNP (SEQ ID NO: 696); AVGL-LAPPGGLSGRSANP (SEQ ID NO: 697); AVGLLAPPG-GLSGRSANI (SEQ ID NO: 698), ISSGLLSGRSDNI (SEQ ID NO: 713); AVGLLAPPGGLSGRSDNI (SEQ ID NO: 714); GLSGRSDNHGGAVGLLAPP (SEQ ID NO: 807); and/or GLSGRSDNHGGVHMPLGFLGP (SEQ ID NO: 808).

In some embodiments, the CM1-CM2 substrate includes the sequence ISSGLLSGRSDNH (SEQ ID NO: 406), which is also referred to herein as substrate 2001. In some embodiments, the CM1-CM2 substrate includes the sequence ISSGLLSSGGSGGSLSGRSDNH (SEQ ID NO: 407), which is also referred to herein as substrate 1001/LP'/0001, where LP' as used in this CM1-CM2 substrate is the amino acid sequence GGSGGS (SEQ ID NO: 1037). In some embodiments, the CM1-CM2 substrate includes the sequence AVGLLAPPGGTSTSGRSANPRG (SEQ ID NO: 408), which is also referred to herein as substrate 2015 and/or substrate 1004/LP'/0003, where LP' as used in this CM1-CM2 substrate is the amino acid sequence GG. In some embodiments, the CM1-CM2 substrate includes the sequence TSTSGRSANPRGGGAVGLLAPP (SEQ ID NO: 409), which is also referred to herein as substrate 0003/LP'/1004, where LP' as used in this CM1-CM2 substrate is the amino acid sequence GG. In some embodiments, the CM1-CM2 substrate includes the sequence VHMPLGFLGPG-GTSTSGRSANPRG (SEQ ID NO: 410), which is also referred to herein as substrate 1003/LP'/0003, where LP' as used in this CM1-CM2 substrate is the amino acid sequence GG. In some embodiments, the CM1-CM2 substrate includes the sequence TSTSGRSANPRGGGVHMPLG-FLGP (SEQ ID NO: 411), which is also referred to herein as substrate 0003/LP'/1003, where LP' as used in this CM1-CM2 substrate is the amino acid sequence GG. In some embodiments, the CM1-CM2 substrate includes the sequence AVGLLAPPGGLSGRSDNH (SEQ ID NO: 412), which is also referred to herein as substrate 3001 and/or substrate 1004/LP'/0001, where LP' as used in this CM1-CM2 substrate is the amino acid sequence GG. In some embodiments, the CM1-CM2 substrate includes the sequence LSGRSDNHGGAVGLLAPP (SEQ ID NO: 413), which is also referred to herein as substrate 0001/LP'/1004, where LP' as used in this CM1-CM2 substrate is the amino acid sequence GG. In some embodiments, the CM1-CM2 substrate includes the sequence VHMPLGFLGPGGLS-GRSDNH (SEQ ID NO: 414), which is also referred to herein as substrate 1003/LP'/0001, wherein LP' as used in this CM1-CM2 substrate is the amino acid sequence GG. In some embodiments, the CM1-CM2 substrate includes the sequence LSGRSDNHGGVHMPLGFLGP (SEQ ID NO: 415), which is also referred to herein as substrate 0001/LP'/1003, where LP' as used in this CM1-CM2 substrate is the amino acid sequence GG. In some embodiments, the CM1-CM2 substrate includes the sequence LSGRSDNHGGSGG-SISSGLLSS (SEQ ID NO: 416), which is also referred to herein as substrate 0001/LP'/1001, where LP' as used in this CM1-CM2 substrate is the amino acid sequence GGSGGS (SEQ ID NO: 1037). In some embodiments, the CM1-CM2 substrate includes the sequence LSGRSGNHGGSGGSISS-GLLSS (SEQ ID NO: 417), which is also referred to herein as substrate 0002/LP'/1001, where LP' as used in this CM1-CM2 substrate is the amino acid sequence GGSGGS (SEQ ID NO: 1037). In some embodiments, the CM1-CM2 substrate includes the sequence ISSGLLSSGGSGGSLS-GRSGNH (SEQ ID NO: 418), which is also referred to herein as substrate 1001/LP'/0002, where LP' as used in this CM1-CM2 substrate is the amino acid sequence GGSGGS (SEQ ID NO: 1037). In some embodiments, the CM1-CM2 substrate includes the sequence LSGRSDNHGGSGGSQN-QALRMA (SEQ ID NO: 419), which is also referred to herein as substrate 0001/LP'/1002, where LP' as used in this CM1-CM2 substrate is the amino acid sequence GGSGGS (SEQ ID NO: 1037). In some embodiments, the CM1-CM2 substrate includes the sequence QNQALRMAGGSGGSLS-GRSDNH (SEQ ID NO: 420), which is also referred to herein as substrate 1002/LP'/0001, where LP' as used in this CM1-CM2 substrate is the amino acid sequence GGSGGS (SEQ ID NO: 1037). In some embodiments, the CM1-CM2 substrate includes the sequence LSGRSGNHGGSGGSQN-QALRMA (SEQ ID NO: 421), which is also referred to herein as substrate 0002/LP'/1002, where LP' as used in this CM1-CM2 substrate is the amino acid sequence GGSGGS (SEQ ID NO: 1037). In some embodiments, the CM1-CM2 substrate includes the sequence QNQALRMAGGSGGSLS-GRSGNH (SEQ ID NO: 422), which is also referred to herein as substrate 1002/LP'/0002, where LP' as used in this CM1-CM2 substrate is the amino acid sequence GGSGGS (SEQ ID NO: 1037). In some embodiments, the CM1-CM2 substrate includes the sequence ISSGLLSGRSGNH (SEQ ID NO: 423), which is also referred to herein as substrate 2002. In some embodiments, the CM1-CM2 substrate includes the sequence ISSGLLSGRSANPRG (SEQ ID NO: 680), which is also referred to herein as substrate 2003. In some embodiments, the CM1-CM2 substrate includes the sequence AVGLLAPPTSGRSANPRG (SEQ ID NO: 681), which is also referred to herein as substrate 2004. In some embodiments, the CM1-CM2 substrate includes the sequence AVGLLAPPSGRSANPRG (SEQ ID NO: 682), which is also referred to herein as substrate 2005. In some embodiments, the CM1-CM2 substrate includes the sequence ISSGLLSGRSDDH (SEQ ID NO: 683), which is also referred to herein as substrate 2006. In some embodiments, the CM1-CM2 substrate includes the sequence ISS-GLLSGRSDIH (SEQ ID NO: 684), which is also referred to herein as substrate 2007. In some embodiments, the CM1-CM2 substrate includes the sequence ISSGLLSGRSDQH (SEQ ID NO: 685), which is also referred to herein as substrate 2008. In some embodiments, the CM1-CM2 substrate includes the sequence ISSGLLSGRSDTH (SEQ ID NO: 686), which is also referred to herein as substrate 2009. In some embodiments, the CM1-CM2 substrate includes the sequence ISSGLLSGRSDYH (SEQ ID NO: 687), which is also referred to herein as substrate 2010. In some embodiments, the CM1-CM2 substrate includes the sequence ISSGLLSGRSDNP (SEQ ID NO: 688), which is also referred to herein as substrate 2011. In some embodiments, the CM1-CM2 substrate includes the sequence ISSGLLSGRSANP (SEQ ID NO: 689), which is also referred to herein as substrate 2012. In some embodiments, the CM1-CM2 substrate includes the sequence ISSGLLSGRSANI (SEQ ID NO: 690), which is also referred to herein as substrate 2013. In some embodiments, the CM1-CM2 substrate includes the sequence AVGLLAPPGGLSGRSDDH (SEQ ID NO: 691), which is also referred to herein as substrate 3006. In some embodiments, the CM1-CM2 substrate includes the sequence AVGLLAPPGGLSGRSDIH (SEQ ID NO: 692), which is also referred to herein as substrate 3007. In some embodiments, the CM1-CM2 substrate includes the sequence AVGLLAPPGGLSGRSDQH (SEQ ID NO: 693), which is also referred to herein as substrate 3008. In some embodiments, the CM1-CM2 substrate includes the sequence AVGLLAPPGGLSGRSDTH (SEQ ID NO: 694), which is also referred to herein as substrate 3009. In some embodiments, the CM1-CM2 substrate includes the sequence AVGLLAPPGGLSGRSDYH (SEQ ID NO: 695), which is also referred to herein as substrate 3010. In some embodiments, the CM1-CM2 substrate includes the sequence AVGLLAPPGGLSGRSDNP (SEQ ID NO: 696), which is also referred to herein as substrate 3011. In some embodiments, the CM1-CM2 substrate includes the sequence AVGLLAPPGGLSGRSANP (SEQ ID NO: 697), which is also referred to herein as substrate 3012. In some embodiments, the CM1-CM2 substrate includes the sequence AVGLLAPPGGLSGRSANI (SEQ ID NO: 698), which is also referred to herein as substrate 3013. In some embodiments, the CM1-CM2 substrate includes the sequence ISSGLLSGRSDNI (SEQ ID NO: 713), which is also referred to herein as substrate 2014. In some embodiments, the CM1-CM2 substrate includes the sequence AVGLLAPPGGLSGRSDNI (SEQ ID NO: 714), which is also referred to herein as substrate 3014. In some embodiments, the CM1-CM2 substrate includes the sequence GLSGRSDNHGGAVGLLAPP (SEQ ID NO: 807), which is also referred to herein as substrate 0001/LP'/1004, where LP' as used in this CM1-CM2 substrate is the amino acid sequence GG. In some embodiments, the CM1-CM2 substrate includes the sequence GLSGRSDNHGGVHMPLGFLGP (SEQ ID NO: 808), which is also referred to herein as substrate 0001/LP'/1003, where LP' as used in this CM1-CM2 substrate is the amino acid sequence GG.

In some embodiments, the CM is a substrate for at least two proteases. In some embodiments, each protease is selected from the group consisting of those shown in Table 4. In some embodiments, the CM is a substrate for at least two proteases, wherein one of the proteases is selected from the group consisting of a MMP, thrombin, a neutrophil elastase, a cysteine protease, uPA, legumain and matriptase and the other protease is selected from the group consisting of those shown in Table 4. In some embodiments, the CM is a substrate for at least two proteases selected from the group consisting of a MMP, thrombin, a neutrophil elastase, a cysteine protease, uPA, legumain and matriptase.

In some embodiments, the activatable antibody includes at least a first CM and a second CM. In some embodiments, the first CM and the second CM are each polypeptides of no more than 15 amino acids long. In some embodiments, the first CM and the second CM in the activatable antibody in the uncleaved state have the structural arrangement from N-terminus to C-terminus as follows: MM-CM1-CM2-AB or AB-CM2-CM1-MM. In some embodiments, at least one of the first CM and the second CM is a polypeptide that functions as a substrate for a protease selected from the group consisting of a MMP, thrombin, a neutrophil elastase, a cysteine protease, uPA, legumain, and matriptase. In some embodiments, the first CM is cleaved by a first cleaving agent selected from the group consisting of a MMP, thrombin, a neutrophil elastase, a cysteine protease, uPA, legumain, and matriptase in a target tissue and the second CM is cleaved by a second cleaving agent in a target tissue. In some embodiments, the other protease is selected from the group consisting of those shown in Table 4. In some embodiments, the first cleaving agent and the second cleaving agent are the same protease selected from the group consisting of a MMP, thrombin, a neutrophil elastase, a cysteine protease, uPA, legumain, and matriptase, and the first CM and the second CM are different substrates for the enzyme. In some embodiments, the first cleaving agent and the second cleaving agent are the same protease selected from the group consisting of those shown in Table 4. In some embodiments, the first cleaving agent and the second cleaving agent are different proteases. In some embodiments, the first cleaving agent and the second cleaving agent are co-localized in the target tissue. In some embodiments, the first CM and the second CM are cleaved by at least one cleaving agent in the target tissue.

In some embodiments, the activatable antibody is exposed to and cleaved by a protease such that, in the activated or cleaved state, the activated antibody includes a light chain amino acid sequence that includes at least a portion of LP2 and/or CM sequence after the protease has cleaved the CM.

Suitable activatable anti-CD71 antibodies of the disclosure also include an antibody or antigen binding fragment thereof that binds to the same epitope on human CD71 and/or cynomolgus monkey CD71 as an anti-CD71 antibody comprising a heavy chain variable region amino acid sequence selected from the group consisting of SEQ ID NO: 1 and 3-5, and a light chain variable region amino acid sequence selected from the group consisting of SEQ ID NO: 2 and 6-8.

Suitable activatable anti-CD71 antibodies of the disclosure also include an antibody or antigen binding fragment thereof that binds to the same epitope on human CD71 and/or cynomolgus monkey CD71 as an anti-CD71 antibody comprising a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

Suitable activatable anti-CD71 antibodies of the disclosure also include an antibody or antigen-binding fragment thereof that binds to the same epitope on human CD71 and/or cynomolgus monkey CD71 as an anti-CD71 antibody comprising a heavy chain variable region amino acid sequence selected from the group consisting of the heavy chain variable region sequences shown in Table 12 and a light chain variable region amino acid sequence selected from the group consisting of the light chain variable region sequences shown in Table 12.

Suitable activatable anti-CD71 antibodies of the disclosure also include an antibody or antigen-binding fragment thereof that binds to the same epitope on human CD71 and/or cynomolgus monkey CD71 as an anti-CD71 antibody comprising a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 13.

Suitable activatable anti-CD71 antibodies of the disclosure also include an antibody or antigen binding fragment thereof that cross-competes for binding to human CD71 and/or cynomolgus monkey CD71 to an anti-CD71 antibody comprising a heavy chain variable region amino acid sequence selected from the group consisting of SEQ ID NO: 1 and 3-5, and a light chain variable region amino acid sequence selected from the group consisting of SEQ ID NO: 2 and 6-8.

Suitable activatable anti-CD71 antibodies of the disclosure also include an antibody or antigen binding fragment thereof that cross-competes for binding to human CD71 and/or cynomolgus monkey CD71 to an anti-CD71 antibody comprising a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

Suitable activatable anti-CD71 antibodies of the disclosure also include an antibody or antigen-binding fragment thereof that cross-competes for binding to human CD71 and/or cynomolgus monkey CD71 as an anti-CD71 antibody comprising a heavy chain variable region amino acid sequence selected from the group consisting of the heavy chain variable region sequences shown in Table 12 and a light chain variable region amino acid sequence selected from the group consisting of the light chain variable region sequences shown in Table 12.

Suitable activatable anti-CD71 antibodies of the disclosure also include an antibody or antigen-binding fragment thereof that cross-competes for binding to human CD71 and/or cynomolgus monkey CD71 as an anti-CD71 antibody comprising a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 13.

In some embodiments, the activatable anti-CD71 antibody is an activatable antibody that, in an activated state, binds CD71 comprising: an antibody or an antigen binding fragment thereof (AB) that specifically binds to mammalian CD71, wherein the AB specifically binds human CD71 and cynomolgus monkey CD71; a masking moiety (MM) that inhibits the binding of the AB to CD71 when the activatable antibody is in an uncleaved state; and a cleavable moiety (CM) coupled to the AB, wherein the CM is a polypeptide that functions as a substrate for a protease.

In some embodiments, the MM has a dissociation constant for binding to the AB that is greater than the dissociation constant of the AB to CD71. In some embodiments, the MM does not interfere or compete with the AB for binding to CD71 when the activatable antibody is in a cleaved state. In some embodiments, the MM is a polypeptide of no more than 40 amino acids in length. In some embodiments, the MM polypeptide sequence is different from that of human CD71. In some embodiments, the MM polypeptide sequence is no more than 50% identical to any natural binding partner of the AB. In some embodiments, the MM comprises an amino acid sequence selected from the group consisting of SEQ ID NOs: 16-295 and 297-314. In some embodiments, the MM comprises an amino acid sequence selected from the group consisting of SEQ ID NOs: 16, 17, and 297-314.

In some embodiments, the CM is a substrate for a protease that is active in diseased tissue. In some embodiments, the CM comprises an amino acid sequence selected from the group consisting of SEQ ID NOs: 356-423, 680-698, 713, 714, and 789-808. In some embodiments, the CM comprises an amino acid sequence selected from the group consisting of SEQ ID NOs: 406-423, 680-698, 713, 714, and 807-808.

In some embodiments, the activatable antibody comprises an antigen binding fragment thereof is selected from the group consisting of a Fab fragment, a F(ab')2 fragment, a scFv, a scAb, a dAb, a single domain heavy chain antibody, and a single domain light chain antibody. In some embodiments, the AB of the activatable antibody specifically binds human CD71. In some embodiments, the AB comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the AB comprises a heavy chain variable region comprising an amino acid sequence selected from the group consisting of SEQ ID NOs: 3-5, and a light chain variable region comprising an amino acid sequence selected from the group consisting of SEQ ID NOs: 6-8 and 809-908.

In some embodiments, the AB is linked to the CM. In some embodiments, the AB is linked directly to the CM. In some embodiments, the AB is linked to the CM via a linking peptide. In some embodiments, the MM is linked to the CM such that the activatable antibody in an uncleaved state comprises the structural arrangement from N-terminus to C-terminus as follows: MM-CM-AB or AB-CM-MM. In some embodiments, the activatable antibody comprises a linking peptide between the MM and the CM. In some embodiments, the activatable antibody comprises a linking peptide between the CM and the AB. In some embodiments, the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM. In some embodiments, the two linking peptides need not be identical to each other. In some embodiments, each of LP1 and LP2 is a peptide of about 1 to 20 amino acids in length.

In some embodiments, the activatable antibody comprises the heavy chain sequence of SEQ ID NO: 325 or 699 and a light chain comprising an amino acid sequence selected from the group consisting of SEQ ID NO: 327, 329, 331, 333, 335, 337, 650, 652, 654, 656, 658, 660, 670-673, 701-712, 721-788, 809-836, and 841-908.

In some embodiments, the activatable antibody comprises a combination of amino acid sequences, wherein the combination of amino acid sequences is selected from a single row in Table D, wherein for a given combination, (a) the heavy chain of the AB comprises the amino acid sequences of the VH CDR sequences corresponding to the given combination in the single row listed in Table D, (b) the light chain of the AB comprises the amino acid sequences of the VL CDR sequences corresponding to the given combination in the single row listed in Table D, (c) the MM comprises the amino acid sequence of the mask sequence (MM) corresponding to the given combination in the single row listed in Table D, and (d) the CM comprises the amino acid sequence of the substrate sequence (CM) corresponding to the given combination in the single row listed in Table D.

In some embodiments, the activatable antibody comprises a combination of amino acid sequences, wherein for a given combination of amino acid sequences, (a) the heavy chain of the AB comprises the amino acid sequences of the VH sequence or VH CDR sequences selected from the group consisting of: the VH sequence or VH CDR sequences listed in the corresponding column of Table E, (b) the light chain of the AB comprises the amino acid sequences of the VL sequence or VL CDR sequences selected from the group consisting of: the VL sequence or VL CDR sequences listed in the corresponding column of Table E, (c) the MM comprises the amino acid sequence of the mask sequence (MM) selected from the group consisting of: the MM sequences listed in the corresponding column of Table E, and (d) the CM comprises the amino acid sequence of the substrate sequence (CM) selected from the group consisting of: the CM sequences listed in the corresponding column of Table E.

In some embodiments, the activatable anti-CD71 antibody comprises an antibody or an antigen binding fragment thereof (AB) that specifically binds to mammalian CD71, a MM, and a CM, wherein the activatable antibody comprises: a heavy chain sequence of SEQ ID NOS: 325 or 699; and a light chain comprising an amino acid sequence selected from the group consisting of SEQ ID NOS: 327, 329, 331, 333, 335, 337, 650, 652, 654, 656, 658, 660, 670-673, 701-712, 721-788, 809-836, and 841-908. In some embodiments, the MM comprises an amino acid sequence selected from the group consisting of SEQ ID NOs: 16, 17, and 297-314, and the CM comprises an amino acid sequence selected from the group consisting of SEQ ID NOs: 406-423, 680-698, 713, 714, and 789-808. In some embodiments, the AB comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the AB comprises a heavy chain variable region comprising an amino acid sequence selected from the group consisting of SEQ ID NOs: 3-5, and a light chain variable region comprising an amino acid sequence selected from the group consisting of SEQ ID NOs: 6-8 and 809-908.

In some embodiments, the activatable anti-CD71 antibody comprises an antibody or an antigen binding fragment thereof (AB) that specifically binds to mammalian CD71, wherein the AB specifically binds to the same epitope on human CD71 and/or cynomolgus monkey CD71 as an isolated antibody of the disclosure; a masking moiety (MM) that inhibits the binding of the AB to CD71 when the activatable antibody is in an uncleaved state; and a cleavable moiety (CM) coupled to the AB, wherein the CM is a polypeptide that functions as a substrate for a protease.

In some embodiments, the anti-CD71 activatable antibody of the disclosure comprises an isolated antibody or an antigen binding fragment thereof (AB) that specifically binds to mammalian CD71, wherein the AB specifically binds human CD71 and cynomolgus monkey CD71. In some embodiments, the antibody or antigen binding fragment thereof comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the activatable antibody or antigen binding fragment thereof comprises a heavy chain variable region comprising an amino acid sequence selected from the group consisting of SEQ ID NOs: 3-5, and a light chain variable region comprising an amino acid sequence selected from the group consisting of SEQ ID NOs: 6-8.

In some embodiments, the activatable anti-CD71 antibody comprises an antibody or an antigen binding fragment thereof (AB) that specifically binds to mammalian CD71, wherein the AB specifically cross-competes with an isolated antibody of the disclosure for binding to human CD71 and/or cynomolgus monkey CD71; a masking moiety (MM) that inhibits the binding of the AB to CD71 when the activatable antibody is in an uncleaved state; and a cleavable moiety (CM) coupled to the AB, wherein the CM is a polypeptide that functions as a substrate for a protease.

In some embodiments, the anti-CD71 activatable antibody of the disclosure comprises an isolated antibody or an antigen binding fragment thereof (AB) that specifically binds to mammalian CD71, wherein the AB specifically binds human CD71 and cynomolgus monkey CD71. In some embodiments, the antibody or antigen binding fragment thereof comprises the VH CDR1 sequence GYTFT-SYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the activatable antibody or antigen binding fragment thereof comprises a heavy chain variable region comprising an amino acid sequence selected from the group consisting of SEQ ID NOs: 3-5, and a light chain variable region comprising an amino acid sequence selected from the group consisting of SEQ ID NOs: 6-8.

In some embodiments, the activatable antibody also includes an agent conjugated to the AB. In some embodiments, the agent conjugated to the AB or the AB of an activatable antibody is a therapeutic agent. In some embodiments, the agent is an antineoplastic agent. In some embodiments, the agent is a toxin or fragment thereof. As used herein, a fragment of a toxin is a fragment that retains toxic activity. In some embodiments, the agent is conjugated to the AB via a cleavable linker. In some embodiments, the agent is conjugated to the AB via a linker that includes at least one CM1-CM2 substrate sequence. In some embodiments, the agent is conjugated to the AB via a noncleavable linker. In some embodiments, the agent is conjugated to the AB via a linker that is cleavable in an intracellular or lysosomal environment. In some embodiments, the agent is a microtubule inhibitor. In some embodiments, the agent is a nucleic acid damaging agent, such as a DNA alkylator, a DNA cleaving agent, a DNA cross-linker, a DNA intercalator, or other DNA damaging agent. In some embodiments, the agent is an agent selected from the group listed in Table 5. In some embodiments, the agent is a dolastatin. In some embodiments, the agent is an auristatin or derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid or maytansinoid derivative. In some embodiments, the agent is DM1 or DM4. In some embodiments, the agent is a duocarmycin or derivative thereof. In some embodiments, the agent is a calicheamicin or derivative thereof. In some embodiments, the agent is a pyrrolobenzodiazepine. In some embodiments, the agent is a pyrrolobenzodiazepine dimer.

In some embodiments, the activatable antibody is conjugated to one or more equivalents of an agent. In some embodiments, the activatable antibody is conjugated to one equivalent of the agent. In some embodiments, the activatable antibody is conjugated to two, three, four, five, six, seven, eight, nine, ten, or greater than ten equivalents of the agent. In some embodiments, the activatable antibody is part of a mixture of activatable antibodies having a homogeneous number of equivalents of conjugated agents. In some embodiments, the activatable antibody is part of a mixture of activatable antibodies having a heterogeneous number of equivalents of conjugated agents. In some embodiments, the mixture of activatable antibodies is such that the average number of agents conjugated to each activatable antibody is between zero to one, between one to two, between two and three, between three and four, between four and five, between five and six, between six and seven, between seven and eight, between eight and nine, between nine and ten, and ten and greater. In some embodiments, the mixture of activatable antibodies is such that the average number of agents conjugated to each activatable antibody is one, two, three, four, five, six, seven, eight, nine, ten, or greater.

In some embodiments, the activatable antibody comprises one or more site-specific amino acid sequence modifications such that the number of lysine and/or cysteine residues is increased or decreased with respect to the original amino acid sequence of the activatable antibody, thus in some embodiments correspondingly increasing or decreasing the number of agents that can be conjugated to the activatable antibody, or in some embodiments limiting the conjugation of the agents to the activatable antibody in a site-specific manner. In some embodiments, the modified activatable antibody is modified with one or more non-natural amino acids in a site-specific manner, thus in some embodiments limiting the conjugation of the agents to only the sites of the non-natural amino acids.

In some embodiments, the agent is an anti-inflammatory agent.

In some embodiments, the activatable antibody also includes a detectable moiety. In some embodiments, the detectable moiety is a diagnostic agent.

In some embodiments, the activatable antibody also includes a signal peptide. In some embodiments, the signal peptide is conjugated to the activatable antibody via a spacer. In some embodiments, the spacer is conjugated to the activatable antibody in the absence of a signal peptide. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. An example of a spacer joined directly to the N-terminus of MM of the activatable antibody is QGQSGQ (SEQ ID NO: 424). Other examples of a spacer joined directly to the N-terminus of MM of the activatable antibody include QGQSGQG (SEQ ID NO: 645), QGQSG (SEQ ID NO: 646), QGQS (SEQ ID NO: 647), QGQ (SEQ ID NO: 648), QG (SEQ ID NO: 649), and Q. Other examples of a spacer joined directly to the N-terminus of MM of the activatable antibody include GQSGQG (SEQ ID NO: 666), QSGQG (SEQ ID NO: 667), SGQG (SEQ ID NO: 668), GQG (SEQ ID NO: 669), and G. In some embodiments, no spacer is joined to the N-terminus of the MM. In some embodiments, the spacer includes at least the amino acid sequence QGQSGQ (SEQ ID NO: 424). In some embodiments, the spacer includes at least the amino acid sequence QGQSGQG (SEQ ID NO: 645). In some embodiments, the spacer includes at least the amino acid sequence QGQSG (SEQ ID NO: 646). In some embodiments, the spacer includes at least the amino acid sequence QGQS (SEQ ID NO: 647). In some embodiments, the spacer includes at least the amino acid sequence QGQ (SEQ ID NO: 648). In some embodiments, the spacer includes at least the amino acid sequence QG (SEQ ID NO: 649). In some embodiments, the spacer includes at least the amino acid residue Q. In some embodiments, the spacer includes at least the amino acid sequence GQSGQG (SEQ ID NO: 666). In some embodiments, the spacer includes at least the amino acid sequence QSGQG (SEQ ID NO: 667). In some embodiments, the spacer includes at least the amino acid sequence SGQG (SEQ ID NO: 668). In some embodiments, the spacer includes at least the amino acid sequence GQG (SEQ ID NO: 669). In some embodiments, the spacer includes at least the amino acid sequence G. In some embodiments, the spacer is absent.

In some embodiments, the AB of the activatable antibody naturally contains one or more disulfide bonds. In some embodiments, the AB can be engineered to include one or more disulfide bonds.

In some embodiments, activatable antibody or antigen binding fragment thereof is conjugated to an agent. In some embodiments, the activatable antibody comprises an antibody or antigen binding fragment thereof cross-competes with an isolated antibody that comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSS-VYYMY (SEQ ID NO: 13); the VL CDR2 sequence STSN-LAS (SEQ ID NO: 14); and the VL CDR3 sequence QQRRNYPYT (SEQ ID NO: 15). In some embodiments, the activatable antibody comprises an antibody or antigen binding fragment thereof cross-competes with an isolated antibody that comprises a heavy chain variable region comprising an amino acid sequence selected from the group consisting of SEQ ID NOs: 3-5, and a light chain variable region comprising an amino acid sequence selected from the group consisting of SEQ ID NOs: 6-8. In some embodiments, the agent is a toxin or fragment thereof. In some embodiments, the agent is a microtubule inhibitor. In some embodiments, the agent is a nucleic acid damaging agent. In some embodiments, the agent is selected from the group consisting of a dolastatin or a derivative thereof, an auristatin or a derivative thereof, a maytansinoid or a derivative thereof, a duocarmycin or a derivative thereof, a calicheamicin or a derivative thereof, and a pyrrolobenzodiazepine or a derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid selected from the group consisting of DM1 and DM4. In some embodiments, the agent is maytansinoid DM4. In some embodiments, the agent is duocarmycin. In some embodiments, the agent is conjugated to the AB via a linker. In some embodiments, the linker with which the agent is conjugated to the AB comprises an SPDB moiety, a vc moiety, or a PEG2-vc moiety. In some embodiments, the linker and toxin conjugated to the AB comprises an SPDB-DM4 moiety, a vc-MMAD moiety, a vc-MMAE moiety, vc-duocarmycin, or a PEG2-vc-MMAD moiety. In some embodiments, the linker is a cleavable linker. In some embodiments, the linker is a non-cleavable linker. In some embodiments, the agent is a detectable moiety. In some embodiments, the detectable moiety is a diagnostic agent.

In some embodiments, the conjugated activatable antibody comprises a conjugated activatable antibody that, in an activated state, binds CD71 comprising: an antibody or an antigen binding fragment thereof (AB) that specifically binds to mammalian CD71, wherein the AB specifically binds human CD71 and cynomolgus monkey CD71; a masking moiety (MM) that inhibits the binding of the AB to CD71 when the activatable antibody is in an uncleaved state; a cleavable moiety (CM) coupled to the AB, wherein the CM is a polypeptide that functions as a substrate for a protease; and an agent conjugated to the AB. In some embodiments, the agent is selected from the group consisting of a dolastatin or a derivative thereof, an auristatin or a derivative thereof, a maytansinoid or a derivative thereof, a duocarmycin or a derivative thereof, a calicheamicin or a derivative thereof, and a pyrrolobenzodiazepine or a derivative thereof. In some embodiments, the agent is selected from the group consisting of auristatin E, monomethyl auristatin F (MMAF), monomethyl auristatin E (MMAE), monomethyl auristatin D (MMAD), maytansinoid DM4, maytansinoid DM1, a duocarmycin, a pyrrolobenzodiazepine, and a pyrrolobenzodiazepine dimer. In some embodiments, the agent is conjugated to the AB via a linker. In some embodiments, the linker with which the agent is conjugated to the AB comprises an SPDB moiety, a vc moiety, or a PEG2-vc moiety. In some embodiments, the linker and toxin conjugated to the AB comprises an SPDB-DM4 moiety, a vc-MMAD moiety, a vc-MMAE moiety, vc-duocarmycin, or a PEG2-vc-MMAD moiety. In some embodiments, the AB of the conjugated activatable antibody or antigen binding fragment thereof comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15). In some embodiments, the AB of the conjugated activatable antibody or antigen binding fragment thereof comprises a heavy chain variable region comprising an amino acid sequence selected from the group consisting of SEQ ID NOs: 3-5, and a light chain variable region comprising an amino acid sequence selected from the group consisting of SEQ ID NOs: 6-8 and 809-908. In some embodiments, the MM comprises an amino acid sequence selected from the group consisting of SEQ ID NOs: 16-295 and 297-314. In some embodiments, the MM comprises an amino acid sequence selected from the group consisting of SEQ ID NOs: 16, 17, and 297-314. In some embodiments, the CM comprises an amino acid sequence selected from the group consisting of SEQ ID NOs: 356-423, 680-698, 713, 714, and 789-808. In some embodiments, the CM comprises an amino acid sequence selected from the group consisting of SEQ ID NOs: 406-423, 680-698, 713, 714, and 807-808. In some embodiments, the activatable antibody comprises a combination of amino acid sequences, wherein the combination of amino acid sequences is selected from a single row in Table D, wherein for a given combination, (a) the heavy chain of the AB comprises the amino acid sequences of the VH CDR sequences corresponding to the given combination in the single row listed in Table D, (b) the light chain of the AB comprises the amino acid sequences of the VL CDR sequences corresponding to the given combination in the single row listed in Table D, (c) the MM comprises the amino acid sequence of the mask sequence (MM) corresponding to the given combination in the single row listed in Table D, and (d) the CM comprises the amino acid sequence of the substrate sequence (CM) corresponding to the given combination in the single row listed in Table D. In some embodiments, the activatable antibody comprises a combination of amino acid sequences, wherein for a given combination of amino acid sequences, (a) the heavy chain of the AB comprises the amino acid sequences of the VH sequence or VH CDR sequences selected from the group consisting of: the VH sequence or VH CDR sequences listed in the corresponding column of Table E, (b) the light chain of the AB comprises the amino acid sequences of the VL sequence or VL CDR sequences selected from the group consisting of: the VL sequence or VL CDR sequences listed in the corresponding column of Table E, (c) the MM comprises the amino acid sequence of the mask sequence (MM) selected from the group consisting of: the MM sequences listed in the corresponding column of Table E, and (d) the CM comprises the amino acid sequence of the substrate sequence (CM)

selected from the group consisting of: the CM sequences listed in the corresponding column of Table E. In some embodiments, the activatable antibody comprises: a heavy chain comprising the amino acid sequence of SEQ ID NOS: 325 or 699; and a light chain comprising an amino acid sequence selected from the group consisting of SEQ ID NOS: 327, 329, 331, 333, 335, 337, 650, 652, 654, 656, 658, 660, 670-673, 701-712, 721-788, 809-836, and 841-908.

In some embodiments, the conjugated activatable antibody comprises a conjugated activatable antibody that, in an activated state, binds to CD71, comprising: an antibody or an antigen binding fragment thereof (AB) that specifically binds to mammalian CD71, wherein the AB specifically binds human CD71 and cynomolgus monkey CD71; a masking moiety (MM) that inhibits the binding of the AB to CD71 when the activatable antibody is in an uncleaved state; a cleavable moiety (CM) coupled to the AB, wherein the CM is a polypeptide that functions as a substrate for a protease; and an agent conjugated to the AB, wherein the AB comprises: (i) the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15), or (ii) a heavy chain variable region comprising an amino acid sequence selected from the group consisting of SEQ ID NOs: 3-5, and a light chain variable region comprising an amino acid sequence selected from the group consisting of SEQ ID NOs: 6-8, or (iii) a heavy chain comprising the amino acid sequence of SEQ ID NOS: 325 or 699, and a light chain comprising an amino acid sequence selected from the group consisting of SEQ ID NOS: 327, 329, 331, 333, 335, 337, 650, 652, 654, 656, 658, 660, 670-673, 701-712, 721-788, 809-836, and 841-908; and wherein the agent is selected from the group consisting of auristatin E, monomethyl auristatin F (MMAF), monomethyl auristatin E (MMAE), monomethyl auristatin D (MMAD), maytansinoid DM4, maytansinoid DM1, a pyrrolobenzodiazepine, a pyrrolobenzodiazepine dimer, and a duocarmycin. In some embodiments, the MM comprises an amino acid sequence selected from the group consisting of SEQ ID NOs: 16-295 and 297-314. In some embodiments, the MM comprises an amino acid sequence selected from the group consisting of SEQ ID NOs: 16, 17, and 297-314. In some embodiments, the CM comprises an amino acid sequence selected from the group consisting of SEQ ID NOs: 356-423, 680-698, 713, 714, and 789-808. In some embodiments, the CM comprises an amino acid sequence selected from the group consisting of SEQ ID NOs: 406-423, 680-698, 713, 714, and 807-808. In some embodiments, the agent is conjugated to the AB via a linker, and wherein the linker to which the agent is conjugated to the AB comprises an SPDB moiety, a vc moiety, or a PEG2-vc moiety. In some embodiments, the linker and toxin conjugated to the AB comprises an SPDB-DM4 moiety, a vc-MMAD moiety, a vc-MMAE moiety, vc-duocarmycin, or a PEG2-vc-MMAD moiety.

In some embodiments, the conjugated activatable antibody comprises a conjugated activatable antibody or conjugated antibody comprising: an antibody or antigen binding fragment thereof (AB) that, in an activated state, binds CD71; and a toxin conjugated to the AB via a linker, wherein the conjugated activatable antibody or the conjugated antibody comprises amino acid sequences, a linker, and a toxin selected from a single row in Table F, wherein for the given combination: (a) the AB comprises a heavy chain comprising the amino acid sequence of the heavy chain sequence or heavy chain variable domain sequence corresponding to the given combination in the single row listed in Table F, (b) the AB comprises a light chain comprising the amino acid sequence of the light chain sequence or light chain variable domain sequence corresponding to the given combination in the single row listed in Table F, and (c) the linker and the toxin comprise the linker and the toxin corresponding to the given combination in the single row listed in Table F.

In some embodiments, the activatable antibody is encoded by a nucleic acid sequence that comprises a nucleic acid sequence encoding a heavy chain variable region amino acid sequence selected from the group consisting of SEQ ID NO: 1 and 3-5. In some embodiments, the activatable antibody is encoded by a nucleic acid sequence that comprises a nucleic acid sequence encoding a heavy chain variable region amino acid sequence selected from the group consisting of SEQ ID NO: 3-5.

In some embodiments, the activatable antibody is encoded by a nucleic acid sequence that comprises a nucleic acid sequence encoding a light chain variable region amino acid sequence selected from the group consisting of SEQ ID NO: 2 and 6-8. In some embodiments, the activatable antibody is encoded by a nucleic acid sequence that comprises a nucleic acid sequence encoding a light chain variable region amino acid sequence selected from the group consisting of SEQ ID NO: 6-8.

In some embodiments, the activatable antibody is encoded by a nucleic acid sequence that comprises a nucleic acid sequence encoding a heavy chain variable region amino acid sequence selected from the group consisting of SEQ ID NO: 1 and 3-5, and a nucleic acid sequence encoding a light chain variable region amino acid sequence selected from the group consisting of SEQ ID NO: 2 and 6-8.

In some embodiments, the activatable antibody is encoded by a nucleic acid sequence that comprises a nucleic acid sequence encoding a heavy chain variable region amino acid sequence selected from the group consisting of SEQ ID NO: 3-5, and a nucleic acid sequence encoding a light chain variable region amino acid sequence selected from the group consisting of SEQ ID NO: 6-8.

In some embodiments, the activatable antibody is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain variable region amino acid sequence selected from the group consisting of SEQ ID NO: 1 and 3-5. In some embodiments, the activatable antibody is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain variable region amino acid sequence comprising selected from the group consisting of SEQ ID NO: 3-5.

In some embodiments, the activatable antibody is encoded by a nucleic acid sequence that comprises a nucleic acid sequence that is at least 90%, 91%, 92%, 93%, 94%, 95%, 96%, 97%, 98% or 99% identical to a nucleic acid sequence encoding a light variable region chain amino acid sequence selected from the group consisting of SEQ ID NO: 2 and 6-8. In some embodiments, the activatable antibody is encoded by a nucleic acid sequence that comprises a nucleic acid sequence that is at least 90%, 91%, 92%, 93%, 94%, 95%, 96%, 97%, 98% or 99% identical to a nucleic acid sequence encoding a light chain variable region amino acid sequence selected from the group consisting of SEQ ID NO: 6-8.

In some embodiments, the activatable antibody is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain variable region amino acid sequence selected from the group consisting of SEQ ID NO: 1 and 3-5, and a nucleic acid sequence that is at least 90%, 91%, 92%, 93%, 94%, 95%, 96%, 97%, 98% or 99% identical to a nucleic acid sequence encoding a light chain variable region amino acid sequence selected from the group consisting of SEQ ID NO: 2 and 6-8.

In some embodiments, the activatable antibody is encoded by a nucleic acid sequence that comprises a nucleic acid sequence that is at least 90%, 91%, 92%, 93%, 94%, 95%, 96%, 97%, 98% or 99% identical to a nucleic acid sequence encoding a heavy chain variable region amino acid sequence selected from the group consisting of SEQ ID NO: 3-5, and a nucleic acid sequence that is at least 90%, 91%, 92%, 93%, 94%, 95%, 96%, 97%, 98% or 99% identical to a nucleic acid sequence encoding a light chain variable region amino acid sequence selected from the group consisting of SEQ ID NO: 6-8.

In some embodiments, the activatable antibody is encoded by a nucleic acid sequence that comprises a nucleic acid sequence encoding a heavy chain variable region amino acid sequence selected from the group consisting of the heavy chain variable region sequences shown in Table 12. In some embodiments, the activatable antibody is encoded by a nucleic acid sequence that comprises a nucleic acid sequence encoding a light chain variable region amino acid sequence selected from the group consisting of the light chain variable region sequences shown in Table 12. In some embodiments, the activatable antibody is encoded by a nucleic acid sequence that comprises a nucleic acid sequence encoding a heavy chain variable region amino acid sequence selected from the group consisting of the heavy chain variable region sequences shown in Table 12 and a nucleic acid sequence encoding a light chain variable region amino acid sequence selected from the group consisting of the light chain variable region sequences shown in Table 12.

In some embodiments, the activatable antibody is encoded by a nucleic acid sequence that comprises a nucleic acid sequence encoding a heavy chain variable region amino acid sequence that is at least 90%, 91%, 92%, 93%, 94%, 95%, 96%, 97%, 98% or 99% identical to an amino acid sequence selected from the group consisting of the heavy chain variable region sequences shown in Table 12. In some embodiments, the activatable antibody is encoded by a nucleic acid sequence that comprises a nucleic acid sequence encoding a light chain variable region amino acid sequence that is at least 90%, 91%, 92%, 93%, 94%, 95%, 96%, 97%, 98% or 99% identical to an amino acid sequence selected from the group consisting of the light chain variable region sequences shown in Table 12. In some embodiments, the activatable antibody is encoded by a nucleic acid sequence that comprises a nucleic acid sequence encoding a heavy chain variable region amino acid sequence that is at least 90%, 91%, 92%, 93%, 94%, 95%, 96%, 97%, 98% or 99% identical to an amino acid sequence selected from the group consisting of the heavy chain variable region sequences shown in Table 12 and a nucleic acid sequence that comprises a nucleic acid sequence encoding a light chain variable region amino acid sequence that is at least 90%, 91%, 92%, 93%, 94%, 95%, 96%, 97%, 98% or 99% identical to an amino acid sequence selected from the group consisting of the light chain variable region sequences shown in Table 12.

In some embodiments, the activatable antibody is encoded by a nucleic acid sequence that comprises a nucleic acid sequence encoding a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 13; a VH CDR2 sequence shown in Table 13; a VH CDR3 sequence shown in Table 13; a VL CDR1 sequence shown in Table 13; a VL CDR2 sequence shown in Table 13; and a VL CDR3 sequence shown in Table 13.

In some embodiments, the activatable antibody is encoded by a nucleic acid sequence that comprises a nucleic acid sequence encoding a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 13; a VH CD2 sequence that includes a sequence that is at least 90%, 91%, 92%, 93%, 94%, 95%, 96%, 97%, 98%, 99% or more identical to a VH CDR2 sequence shown in Table 13; a VH CDR3 sequence that includes a sequence that is at least 90%, 91%, 92%, 93%, 94%, 95%, 96%, 97%, 98%, 99% or more identical to a VH CDR3 sequence shown in Table 13; a VL CDR1 sequence that includes a sequence that is at least 90%, 91%, 92%, 93%, 94%, 95%, 96%, 97%, 98%, 99% or more identical to a VL CDR1 sequence shown in Table 13; a VL CDR2 sequence that includes a sequence that is at least 90%, 91%, 92%, 93%, 94%, 95%, 96%, 97%, 98%, 99% or more identical to a VL CDR2 sequence shown in Table 13; and a VL CDR3 sequence that includes a sequence that is at least 90%, 91%, 92%, 93%, 94%, 95%, 96%, 97%, 98%, 99% or more identical to a VL CDR3 sequence shown in Table 13.

In some embodiments, the activatable antibody is encoded by a nucleic acid sequence that comprises a nucleic acid sequence encoding a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 13.

In some embodiments, the activatable antibody is encoded by a nucleic acid sequence that comprises a nucleic acid sequence encoding a light chain variable region that comprise a combination of a VL CDR1 sequence, a VL CDR2 sequence, and a VL CDR3 sequence, wherein the combination is a combination of the three light chain CDR sequences (VL CDR1, VL CDR2, VL CDR3) shown in a single row in Table 13.

In some embodiments, the activatable antibody is encoded by a nucleic acid sequence that comprises a nucleic acid sequence encoding a heavy chain variable region that comprise a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 13.

In some embodiments, the activatable antibody is encoded by a nucleic acid sequence that comprises a nucleic acid sequence encoding a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of the six CDR sequences (VH CDR1, VH CDR2, VH CDR3, VL CDR1, VL CDR2, and VL CDR3) shown in a single row in Table 13.

In some embodiments, the activatable antibody is encoded by a nucleic acid sequence that comprises a nucleic acid sequence encoding a heavy chain variable region that comprise a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 13.

In some embodiments, the activatable antibody is encoded by a nucleic acid sequence that comprises a nucleic acid sequence encoding a light chain variable region that comprise a combination of a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three light chain CDR sequences (VL CDR1, VL CDR2, VL CDR3) shown in a single row in Table 13.

The disclosure also provides methods for producing an activatable antibody of the disclosure by culturing a cell under conditions that lead to expression of the activatable antibody, wherein the cell comprises a nucleic acid molecule of the disclosure or a vector of the disclosure.

The disclosure also provides methods of manufacturing an activatable antibody that, in an activated state, binds CD71, the method comprising: (a) culturing a cell comprising a nucleic acid construct that encodes the activatable antibody under conditions that lead to expression of the activatable antibody, wherein the activatable antibody comprises an activatable antibody of the disclosure; and (b) recovering the activatable antibody.

In some embodiments, the activatable antibody includes one or more polypeptides that include the combination of sequences in a given row of Table D or any combination of a mask sequence (MM), a substrate sequence (CM), a light chain variable domain sequence or light chain variable domain CDR sequences, and a heavy chain variable domain sequence or heavy chain variable domain CDR sequences of Table E.

TABLE D

Anti-CD71 Activatable Antibody Combinations

| Comb. No. | Mask Sequence (MM) | Substrate Sequence (CM) | VL CDRs SEQ ID NOs | VH CDRs SEQ ID NOs |
|---|---|---|---|---|
| 1 | QFCPWSYYLIGDCDI (SEQ ID NO: 16) | LSGRSDNH (SEQ ID NO: 359) | 12, 14, 15 | 9, 10, 11 |
| 2 | QFCPWSYYLIGDCDI (SEQ ID NO: 16) | ISSGLLSS (SEQ ID NO: 382) | 12, 14, 15 | 9, 10, 11 |
| 3 | QFCPWSYYLIGDCDI (SEQ ID NO: 16) | LSGRSGNH (SEQ ID NO: 789) | 12, 14, 15 | 9, 10, 11 |
| 4 | QFCPWSYYLIGDCDI (SEQ ID NO: 16) | AVGLLAPP (SEQ ID NO: 390) | 12, 14, 15 | 9, 10, 11 |
| 5 | QFCPWSYYLIGDCDI (SEQ ID NO: 16) | VHMPLGFLGP (SEQ ID NO: 370) | 12, 14, 15 | 9, 10, 11 |
| 6 | QFCPWSYYLIGDCDI (SEQ ID NO: 16) | TSTSGRSANPRG (SEQ ID NO: 397) | 12, 14, 15 | 9, 10, 11 |
| 7 | QFCPWSYYLIGDCDI (SEQ ID NO: 16) | QNQALRMA (SEQ ID NO: 377) | 12, 14, 15 | 9, 10, 11 |
| 8 | QFCPWSYYLIGDCDI (SEQ ID NO: 16) | ISSGLLSGRSDNH (SEQ ID NO: 406) | 12, 14, 15 | 9, 10, 11 |
| 9 | QFCPWSYYLIGDCDI (SEQ ID NO: 16) | ISSGLLSGRSGNH (SEQ ID NO: 423) | 12, 14, 15 | 9, 10, 11 |
| 10 | QFCPWSYYLIGDCDI (SEQ ID NO: 16) | ISSGLLSGRSANPRG (SEQ ID NO: 680) | 12, 14, 15 | 9, 10, 11 |
| 11 | QFCPWSYYLIGDCDI (SEQ ID NO: 16) | AVGLLAPPTSGRSANPRG (SEQ ID NO: 681) | 12, 14, 15 | 9, 10, 11 |
| 12 | QFCPWSYYLIGDCDI (SEQ ID NO: 16) | AVGLLAPPSGRSANPRG (SEQ ID NO: 682) | 12, 14, 15 | 9, 10, 11 |

TABLE D-continued

Anti-CD71 Activatable Antibody Combinations

| Comb. No. | Mask Sequence (MM) | Substrate Sequence (CM) | VL CDRs SEQ ID NOs | VH CDRs SEQ ID NOs |
|---|---|---|---|---|
| 13 | QFCPWSYLEGDCDI (SEQ ID NO: 16) | ISSGLLSGRSDDH (SEQ ID NO: 683) | 12, 14, 15 | 9, 10, 11 |
| 14 | QFCPWSYYLIGDCDI (SEQ ID NO: 16) | ISSGLLSGRSDIH (SEQ ID NO: 684) | 12, 14, 15 | 9, 10, 11 |
| 15 | QFCPWSYYLIGDCDI (SEQ ID NO: 16) | ISSGLLSGRSDQH (SEQ ID NO: 685) | 12, 14, 15 | 9, 10, 11 |
| 16 | QFCPWSYYLIGDCDI (SEQ ID NO: 16) | ISSGLLSGRSDTH (SEQ ID NO: 686) | 12, 14, 15 | 9, 10, 11 |
| 17 | QFCPWSYYLIGDCDI (SEQ ID NO: 16) | ISGLLSGRSDYH (SEQ ID NO: 687) | 12, 14, 15 | 9, 10 11 |
| 18 | QFCPWSYYLIGDCDI (SEQ ID NO: 16) | ISSGLLSGRSDNP (SEQ ID NO: 688) | 12, 14, 15 | 9, 10, 11 |
| 19 | QFCPWSYYLIGDCDI (SEQ ID NO: 16) | ISSGLLSGRSANP (SEQ ID NO: 689) | 12, 14, 15 | 9, 10, 11 |
| 20 | QFCPWSYYLIGDCDI (SEQ ID NO: 16) | ISSGLLSGRSANI (SEQ ID NO: 690) | 12, 14, 15 | 9, 10, 11 |
| 21 | QFCPWSYYLIGDCDI (SEQ ID NO: 16) | ISSGLLSGRSDNI (SEQ ID NO: 713) | 12, 14, 15 | 9, 10, 11 |
| 22 | QFCPWSYYLIGDCDI (SEQ ID NO: 16) | AVGLLAPPGGLSGRSDNH (SEQ ID NO: 412) | 12, 14, 15 | 9, 10, 11 |
| 23 | QFCPWSYYLIGDCDI (SEQ ID NO: 16) | AVGLLAPPGLSGRSDDH (SEQ ID NO: 691) | 12, 14, 15 | 9, 10, 11 |
| 24 | QFCPWSYYLIGDCDI (SEQ ID NO: 16) | AVGLLAPPGGLSGRSDIH (SEQ ID NO: 692) | 12, 14, 15 | 9, 10, 11 |
| 25 | QFCPWSYYLIGDCDI (SEQ ID NO: 16) | AVGLLAPPGGLSGRSDQH (SEQ ID NO: 693) | 12, 14, 15 | 9, 10, 11 |
| 26 | QFCPWSYYLIGDCDI (SEQ ID NO: 16) | AVGLLAPPGGLSGRSDTH (SEQ ID NO: 694) | 12, 14, 15 | 9, 10, 11 |
| 27 | QFCPWSYYLIGDCDI (SEQ ID NO: 16) | AVGLLAPPGGLSGRSDYH (SEQ ID NO: 695) | 12, 14, 15 | 9, 10, 11 |
| 28 | QFCPWSYYLIGDCDI (SEQ ID NO: 16) | AVGLLAPPGGLSGRSDNP (SEQ ID NO: 696) | 12, 14, 15 | 9, 10, 11 |
| 29 | QFCPWSYYLIGDCDI (SEQ ID NO: 16) | AVGLLAPPGGLSGRSANP (SEQ ID NO: 697) | 12, 14, 15 | 9, 10, 11 |
| 30 | QFCPWSYYLIGDCDI (SEQ ID NO: 16) | AVGLLAPPGGLSGRSANI (SEQ ID NO: 698) | 12, 14, 15 | 9, 10, 11 |
| 31 | QFCPWSYYLIGDCDI (SEQ ID NO: 16) | AVGLLAPPGGLSGRSDNI (SEQ ID NO: 714) | 12, 14, 15 | 9, 10, 11 |
| 32 | QFCPWSYYLIGDCDI (SEQ ID NO: 16) | ISSGLLSSGGSGGSLSGRSDNH (SEQ ID NO: 407) | 12, 14, 15 | 9, 10, 11 |
| 33 | NLCTEHSFALDCRSY (SEQ ID NO: 17) | LSGRSDNH (SEQ ID NO: 359) | 12, 14, 15 | 9, 10, 11 |
| 34 | NLCTEHSFALDCRSY (SEQ ID NO: 17) | ISSGLLSS (SEQ ID NO: 382) | 12, 14, 15 | 9, 10, 11 |
| 35 | NLCTEHSFALDCRSY (SEQ ID NO: 17) | LSGRSGNH (SEQ ID NO: 789) | 12, 14, 15 | 9, 10, 11 |
| 36 | NLCTEHSFALDCRSY (SEQ ID NO: 17) | AVGLLAPP (SEQ ID NO: 390) | 12, 14, 15 | 9, 10, 11 |
| 37 | NLCTEHSFALDCRSY (SEQ ID NO: 17) | VHMPLGFLGP (SEQ ID NO: 370) | 12, 14, 15 | 9, 10, 11 |

TABLE D-continued

Anti-CD71 Activatable Antibody Combinations

| Comb. No. | Mask Sequence (MM) | Substrate Sequence (CM) | VL CDRs SEQ ID NOs | VH CDRs SEQ ID NOs |
|---|---|---|---|---|
| 38 | NLCTEHSFALDCRSY (SEQ ID NO: 17) | TSTSGRSANPRG (SEQ ID NO: 397) | 12, 14, 15 | 9, 10, 11 |
| 39 | NLCTEHSFALDCRSY (SEQ ID NO: 17) | QNQALRMA (SEQ ID NO: 377) | 12, 14, 15 | 9, 10, 11 |
| 40 | NLCTEHSFADCRSY (SEQ ID NO: 17) | ISSGLLSGRSDNH (SEQ ID NO: 406) | 12, 14, 15 | 9, 10, 11 |
| 41 | NLCTEHSFALDCRSY (SEQ ID NO: 17) | ISSGLLSGRSGNH (SEQ ID NO: 423) | 12, 14, 15 | 9, 10, 11 |
| 42 | NLCTEHSFALDCRSY (SEQ ID NO: 17) | ISSGLLSGRSANPRG (SEQ ID NO: 680) | 12, 14, 15 | 9, 10, 11 |
| 43 | NLCTEHSFALDCRSY (SEQ ID NO: 17) | AVGLLAPPTSGRSANPRG (SEQ ID NO: 681) | 12, 14, 15 | 9, 10, 11 |
| 44 | NLCTEHSFALDCRSY (SEQ ID NO: 17) | AVGLLAPPSGRSANPRG (SEQ ID NO: 682) | 12, 14, 15 | 9, 10, 11 |
| 45 | NLCTEHFALDCRSY (SEQ ID NO: 17) | ISSGLLSGRSDDH (SEQ ID NO: 683) | 12, 14, 15 | 9, 10, 11 |
| 46 | NLCTEHSFALDCRSY (SEQ ID NO: 17) | ISSGLLSGRSDIH (SEQ ID NO: 684) | 12, 14, 15 | 9, 10, 11 |
| 47 | NLCTEHSFALDCRSY (SEQ ID NO: 17) | ISSGLLSGRSDQH (SEQ ID NO: 685) | 12, 14, 15 | 9, 10, 11 |
| 48 | NLCTEHSFALDCRSY (SEQ ID NO: 17) | ISSGLLSGRSDTH (SEQ ID NO: 686) | 12, 14, 15 | 9, 10, 11 |
| 49 | NLCTEHSFALDCRSY (SEQ ID NO: 17) | ISSGLLSGRSDYH (SEQ ID NO: 687) | 12, 14, 15 | 9, 10, 11 |
| 50 | NLCTEHSFALDCRSY (SEQ ID NO: 17) | ISSGLLSGRSDNP (SEQ ID NO: 688) | 12, 14, 15 | 9, 10, 11 |
| 51 | NLCTEHSFALDCRSY (SEQ ID NO: 17) | ISSGLLSGRSANP (SEQ ID NO: 689) | 12, 14, 15 | 9, 10, 11 |
| 52 | NLCTEHSFALDCRSY (SEQ ID NO: 17) | ISSGLLSGRSANI (SEQ ID NO: 690) | 12, 14, 15 | 9, 10, 11 |
| 53 | NLCTEHSFALDCRSY (SEQ ID NO: 17) | ISSGLLSGRSDNI (SEQ ID NO: 713) | 12, 14, 15 | 9, 10, 11 |
| 54 | NLCTEHSFALDCRSY (SEQ ID NO: 17) | AVGLLAPPGGLSGRSDNH (SEQ ID NO: 412) | 12, 14, 15 | 9, 10, 11 |
| 55 | NICTEHSFALDCRSY (SEQ ID NO: 17) | AVGLLAPPGGLSGRSDDH (SEQ ID NO: 691) | 12, 14, 15 | 9, 10, 11 |
| 56 | NLCTEHSFALDCRSY (SEQ ID NO: 17) | AVGLLAPPGGLSGRSDIH (SEQ ID NO: 692) | 12, 14, 15 | 9, 10, 11 |
| 57 | NLCTEHSFALDCRSY (SEQ ID NO: 17) | AVGLLAPPGGLSGRSDQH (SEQ ID NO: 693) | 12, 14, 15 | 9, 10, 11 |
| 58 | NLCTEHSFALDCRSY (SEQ ID NO: 17) | AVGLLAPPGGLSGRSDTH (SEQ ID NO: 694) | 12, 14, 15 | 9, 10, 11 |
| 59 | NLCTEHSFALDCRSY (SEQ ID NO: 17) | AVGLLAPPGGLSGRSDYH (SEQ ID NO: 695) | 12, 14, 15 | 9, 10, 11 |
| 60 | NLCTEHSFALDCRSY (SEQ ID NO: 17) | AVGLLAPPGGLSGRSDNP (SEQ ID NO: 696) | 12, 14, 15 | 9, 10, 11 |
| 61 | NLCTEHSFALDCRSY (SEQ ID NO: 17) | AVGLLAPPGGLSGRSANP (SEQ ID NO: 697) | 12, 14, 15 | 9, 10, 11 |

TABLE D-continued

Anti-CD71 Activatable Antibody Combinations

| Comb. No. | Mask Sequence (MM) | Substrate Sequence (CM) | VL CDRs SEQ ID NOs | VH CDRs SEQ ID NOs |
|---|---|---|---|---|
| 62 | NLCTEHSFALDCRSY (SEQ ID NO: 17) | AVGLLAPPGGLSGRSANI (SEQ ID NO: 698) | 12, 14, 15 | 9, 10, 11 |
| 63 | NLCTEHSFALDCRSY (SEQ ID NO: 17) | AVGLLAPPGGLSGRSDNI (SEQ ID NO: 714) | 12, 14, 15 | 9, 10, 11 |
| 64 | NLCTEHSFALDCRSY (SEQ ID NO: 17) | ISSGLLSSGGSGGSLSGRSDNH (SEQ ID NO: 407) | 12, 14, 15 | 9, 10, 11 |
| 65 | NLCTEHSAALDCRSY (SEQ ID NO: 309) | LSGRSDNH (SEQ ID NO: 359) | 12, 14, 15 | 9, 10, 11 |
| 66 | NLCTEHSAALDCRSY (SEQ ID NO: 309) | ISSGLLSS (SEQ ID NO: 382) | 12, 14, 15 | 9, 10, 11 |
| 67 | NLCTEHSAALDCRSY (SEQ ID NO: 309) | LSGRSGNH (SEQ ID NO: 789) | 12, 14, 15 | 9, 10, 11 |
| 68 | NLCTEHSAALDCRSY (SEQ ID NO: 309) | AVGLLAPP (SEQ ID NO: 390) | 12, 14, 15 | 9, 10, 11 |
| 69 | NLCTEHSAALDCRSY (SEQ ID NO: 309) | VHMPLGFLGP (SEQ ID NO: 370) | 12, 14, 15 | 9, 10, 11 |
| 70

TABLE D-continued

Anti-CD71 Activatable Antibody Combinations

| Comb. No. | Mask Sequence (MM) | Substrate Sequence (CM) | VL CDRs SEQ ID NOs | VH CDRs SEQ ID NOs |
|---|---|---|---|---|
| 86 | NLCTEHSAALDCRSY (SEQ ID NO: 309) | AVGLLAPPGGLSGRSDNH (SEQ ID NO: 412) | 12, 14, 15 | 9, 10, 11 |
| 87 | NLCTEHSAALDCRSY (SEQ ID NO: 309) | AVGLLAPPGGLSGRSDDH (SEQ ID NO: 691) | 12, 14, 15 | 9, 10, 11 |
| 88 | NLCTEHSAALDCRSY (SEQ ID NO: 309) | AVGLLAPPGGLSGRSDIH (SEQ ID NO: 692) | 12, 14, 15 | 9, 10, 11 |
| 89 | NLCTEHSAALDCRSY (SEQ ID NO: 309) | AVGLLAPPGGLSGRSDQH (SEQ ID NO: 693) | 12, 14, 15 | 9, 10, 11 |
| 90 | NLCTEHSAALDCRSY (SEQ ID NO: 309) | AVGLLAPPGGLSGRSDTH (SEQ ID NO: 694) | 12, 14, 15 | 9, 10, 11 |
| 91 | NLCTEHSAALDCRSY (SEQ ID NO: 309) | AVGLLAPPGGLSGRSDYH (SEQ ID NO: 695) | 12, 14, 15 | 9, 10, 11 |
| 92 | NLCTEHSAALDCRSY (SEQ ID NO: 309) | AVGLLAPPGGLSGRSDNP (SEQ ID NO: 696) | 12, 14, 15 | 9, 10, 11 |
| 93 | NLCTEHSAALDCRSY (SEQ ID NO: 309) | AVGLLAPPGGLSGRSANP (SEQ ID NO: 697) | 12, 14, 15 | 9, 10, 11 |
| 94 | NLCTEHSAALDCRSY (SEQ ID NO: 309) | AVGLLAPPGGLSGRSANI (SEQ ID NO: 698) | 12, 14, 15 | 9, 10, 11 |
| 95 | NLCTEHSAALDCRSY (SEQ ID NO: 309) | AVGLLAPPGGLSGRSDNI (SEQ ID NO: 714) | 12, 14, 15 | 9, 10, 11 |
| 96 | NLCTEHSAALDCRSY (SEQ ID NO: 309) | ISSGLLSSGGSGGSLSGRSDNH (SEQ ID NO: 407) | 12, 14, 15 | 9, 10, 11 |
| 97 | CTEHSFALDC (SEQ ID NO: 314) | LSGRSDNH (SEQ ID NO: 359) | 12, 14, 15 | 9, 10, 11 |
| 98 | CTEHSFALDC (SEQ ID NO: 314) | ISSGLLSS (SEQ ID NO: 382) | 12, 14, 15 | 9, 10, 11 |
| 99 | CTEHSFALDC (SEQ ID NO: 314) | LSGRSGNH (SEQ ID NO: 789) | 12, 14, 15 | 9, 10, 11 |
| 100 | CTEHSFALDC (SEQ ID NO: 314) | AVGLLAPP (SEQ ID NO: 390) | 12, 14, 15 | 9, 10, 11 |
| 101 | CTEHSFALDC (SEQ ID NO: 314) | VHMPLFLGP (SEQ ID NO: 370) | 12, 14, 15 | 9, 10, 11 |
| 102 | CTEHSFALDC (SEQ ID NO: 314) | TSTSGRSANPRG (SEQ ID NO: 397) | 12, 14, 15 | 9, 10, 11 |
| 103 | CTEHSFALDC (SEQ ID NO: 314) | QNQALRMA (SEQ ID NO: 377) | 12, 14, 15 | 9, 10, 11 |
| 104 | CTEHSFALDC (SEQ ID NO: 314) | ISSGLLSGRSDNH (SEQ ID NO: 406) | 12, 14, 15 | 9, 10, 11 |
| 105 | CTEHSFALDC (SEQ ID NO: 314) | ISSGLLSGRSGNH (SEQ ID NO: 423) | 12, 14, 15 | 9, 10, 11 |
| 106 | CTEHSFALDC (SEQ ID NO: 314) | ISSGLLSGRSANPRG (SEQ ID NO: 680) | 12, 14, 15 | 9, 10, 11 |
| 107 | CTEHSFALDC (SEQ ID NO: 314) | AVGLLAPPTSGRSANPRG (SEQ ID NO: 681) | 12, 14, 15 | 9, 10, 11 |
| 108 | CTEHSFALDC (SEQ ID NO: 314) | AVGLLAPPSGRSANPRG (SEQ ID NO: 682) | 12, 14, 15 | 9, 10, 11 |
| 109 | CTEHSFALDC (SEQ ID NO: 314) | ISSGLLSGRSDDH (SEQ ID NO: 683) | 12, 14, 15 | 9, 10, 11 |

TABLE D-continued

Anti-CD71 Activatable Antibody Combinations

| Comb. No. | Mask Sequence (MM) | Substrate Sequence (CM) | VL CDRs SEQ ID NOs | VH CDRs SEQ ID NOs |
|---|---|---|---|---|
| 110 | CTEHSFALDC (SEQ ID NO: 314) | ISSGLLSGRSDIH (SEQ ID NO: 684) | 12, 14, 15 | 9, 10, 11 |
| 111 | CTEHSFALDC (SEQ ID NO: 314) | ISSGLLSGRSDQH (SEQ ID NO: 685) | 12, 14, 15 | 9, 10, 11 |
| 112 | CTEHSFALDC (SEQ ID NO: 314) | ISSGLLSGRSDTH (SEQ ID NO: 686) | 12, 14, 15 | 9, 10, 11 |
| 113 | CTEHSFALDC (SEQ ID NO: 314) | ISSGLLSGRSDYH (SEQ ID NO: 687) | 12, 14, 15 | 9, 10, 11 |
| 114 | CTEHSFALDC (SEQ ID NO: 314) | ISSGLLSGRSDNP (SEQ ID NO: 688) | 12, 14, 15 | 9, 10, 11 |
| 115 | CTEHSFALDC (SEQ ID NO: 314) | ISSGLLSGRSANP (SEQ ID NO: 689) | 12, 14, 15 | 9, 10, 11 |
| 116 | CTEHSFALDC (SEQ ID NO: 314) | ISSGLLSGRSANI (SEQ ID NO: 690) | 12, 14, 15 | 9, 10, 11 |
| 117 | CTEHSFALDC (SEQ ID NO: 314) | ISSGLLSGRSDNI (SEQ ID NO: 713) | 12, 14, 15 | 9, 10, 11 |
| 118 | CTEHSFALDC (SEQ ID NO: 314) | AVGLLAPPGGLSGRSDNH (SEQ ID NO: 412) | 12, 14, 15 | 9, 10, 11 |
| 119 | CTEHSFALDC (SEQ ID NO: 314) | AVGLLAPPGGLSGRSDDH (SEQ ID NO: 691) | 12, 14, 15 | 9, 10, 11 |
| 120 | CTEHSFALDC (SEQ ID NO: 314) | AVGLLAPPGGLSGRSDIH (SEQ ID NO: 692) | 12, 14, 15 | 9, 10, 11 |
| 121 | CTEHSFALDC (SEQ ID NO: 314) | AVGLLAPPGGLSGRSDQH (SEQ ID NO: 693) | 12, 14, 15 | 9, 10, 11 |
| 122 | CTEHSFALDC (SEQ ID NO: 314) | AVGLLAPPGGLSGRSDTH (SEQ ID NO: 694) | 12, 14, 15 | 9, 10, 11 |
| 123 | CTEHSFALDC (SEQ ID NO: 314) | AVGLLAPPGGLSGRSDYH (SEQ ID NO: 695) | 12, 14, 15 | 9, 10, 11 |
| 124 | CTEHSFALDC (SEQ ID NO: 314) | AVGLLAPPGGLSGRSDNP (SEQ ID NO: 696) | 12, 14, 15 | 9, 10, 11 |
| 125 | CTEHSFALDC (SEQ ID NO: 314) | AVGLLAPPGGLSGRSANP (SEQ ID NO: 697) | 12, 14, 15 | 9, 10, 11 |
| 126 | CTEHSFALDC (SEQ ID NO: 314) | AVGLLAPPGGLSGRSANI (SEQ ID NO: 698) | 12, 14, 15 | 9, 10, 11 |
| 127 | CTEHSFALDC (SEQ ID NO: 314) | AVGLLAPPGGLSGRSDNI (SEQ ID NO: 714) | 12, 14, 15 | 9, 10, 11 |
| 128 | CTEHSFALDC (SEQ ID NO: 314) | ISSGLLSSGGSGGSLSGRSDNH (SEQ ID NO: 407) | 12, 14, 15 | 9, 10, 11 |

TABLE E

Anti-CD71 Activatable Antibody Components

| Mask Sequence (MM) | Substrate Sequence (CM) | VL or VL CDRs | VH or VH CDRs |
|---|---|---|---|
| QFCPWSYYLIGDCDI (SEQ ID NO: 16) | LSGRSDNH (SEQ ID NO: 359) | SEQ ID NOS: 12, 14, 15 | SEQ ID NOS: 9, 10, 11 |
| QFCAWSYYLIGDCDI (SEQ ID NO: 297) | TGRGPSWV (SEQ ID NO: 356) | SEQ ID NO: 6 | SEQ ID NO: 3 |

TABLE E-continued

Anti-CD71 Activatable Antibody Components

| Mask Sequence (MM) | Substrate Sequence (CM) | VL or VL CDRs | VH or VH CDRs |
|---|---|---|---|
| QFCPASYYLIGDCDI (SEQ ID NO: 298) | PLTGRSGG (SEQ ID NO: 362) | SEQ ID NO: 7 | SEQ ID NO: 4 |
| QFCPWAYYLIGDCDI (SEQ ID NO: 299) | TARGPSFK (SEQ ID NO: 353) | SEQ ID NO: 3 | SEQ ID NO: 5 |
| QFCPWSAYLIGDCDI (SEQ ID NO: 300) | NTLSGRSENHSG (SEQ ID NO: 395) | SEQ ID NOS: 13, 14, 15 | |
| QFCPWSYALIGDCDI (SEQ ID NO: 301) | NTLSGRSGNHGS (SEQ ID NO: 396) | | |
| QFCPWSYYAIGDCDI (SEQ ID NO: 302) | TSTSGRSANPRG (SEQ ID NO: 397) | | |
| QFCPWSYYLAGDCDI (SEQ ID NO: 303) | TSGRSANP (SEQ ID NO: 398) | | |
| QFCPWSYYLIGACDI (SEQ ID NO: 304) | VHMPLGFLGP (SEQ ID NO: 370) | | |
| NLCTEHSFALDCRSY (SEQ ID NO: 17) | AVGLLAPP (SEQ ID NO: 390) | | |
| NLCAEHSFALDCRSY (SEQ ID NO: 305) | AQNLLGMV (SEQ ID NO: 373) | | |
| NLCTAHSFALDCRSY (SEQ ID NO: 306) | QNQALRMA (SEQ ID NO: 377) | | |
| NLCTEASFALDCRSY (SEQ ID NO: 307) | LAAPLGLL (SEQ ID NO: 339) | | |
| NLCTEHAFALDCRSY (SEQ ID NO: 308) | STFPFGMF (SEQ ID NO: 379) | | |
| NLCTEHSAALDCRSY (SEQ ID NO: 309) | ISSGLLSS (SEQ ID NO: 382) | | |
| NICTEHSFAADCRSY (SEQ ID NO: 310) | PAGLWLDP (SEQ ID NO: 392) | | |
| NLCTEHSFALACRSY (SEQ ID NO: 311) | VAGRSMRP (SEQ ID NO: 399) | | |
| NLCTEHSFALDCASY (SEQ ID NO: 312) | VVPEGRRS (SEQ ID NO: 400) | | |
| CTEHSFALDCRSY (SEQ ID NO: 313) | ILPRSPAF (SEQ ID NO: 401) | | |
| CTEHSFALDC (SEQ ID NO: 314) | MVLGRSLL (SEQ ID NO: 402) | | |
| | QGRAITFI (SEQ ID NO: 403) | | |
| | SPRSIMLA (SEQ ID NO: 404) | | |
| | SMLRSMPL (SEQ ID NO: 405) | | |
| | ISSGLLSGRSDNH (SEQ ID NO: 406) | | |
| | AVGLLAPPGGLSGRSDNH (SEQ ID NO: 412) | | |
| | ISSGLLSSGGSGGSLSGRSDNH (SEQ ID NO: 407) | | |

TABLE E-continued

Anti-CD71 Activatable Antibody Components

| Mask Sequence (MM) | Substrate Sequence (CM) | VL or VL CDRs | VH or VH CDRs |
|---|---|---|---|
| | LSGRSGNH (SEQ ID NO: 789) | | |
| | SGRSANPRG (SEQ ID NO: 790) | | |
| | LSGRSDDH (SEQ ID NO: 791) | | |
| | LSGRSDIH (SEQ ID NO: 792) | | |
| | LSGRSDQH (SEQ ID NO: 793) | | |
| | LSGRSDTH (SEQ ID NO: 794) | | |
| | LSGRSDYH (SEQ ID NO: 795) | | |
| | LSGRSDNP (SEQ ID NO: 796) | | |
| | LSGRSANP (SEQ ID NO: 797) | | |
| | LSGRSANI (SEQ ID NO: 798) | | |
| | LSGRSDNI (SEQ ID NO: 799) | | |
| | MIAPVAYR (SEQ ID NO: 800) | | |
| | RPSPMWAY (SEQ ID NO: 801) | | |
| | WATPRPMR (SEQ ID NO: 802) | | |
| | FRLLDWQW (SEQ ID NO: 803) | | |
| | ISSGL (SEQ ID NO: 804) | | |
| | ISSGLLS (SEQ ID NO: 805) | | |
| | ISSGLL (SEQ ID NO: 806) | | |
| | ISSGLLSGRSANPRG (SEQ ID NO: 680) | | |
| | AVGLLAPPTSGRSANPRG (SEQ ID NO: 681) | | |
| | AVGLLAPPSGRSANPRG (SEQ ID NO: 682) | | |
| | ISSGLLSGRSDDH (SEQ ID NO: 683) | | |
| | ISSGLLSGRSDIH (SEQ ID NO: 634) | | |
| | ISSGLLSGRSDQH (SEQ ID NO: 635) | | |
| | ISSGLLSGRSDTH (SEQ ID NO: 686 | | |

TABLE E-continued

Anti-CD71 Activatable Antibody Components

| Mask Sequence (MM) | Substrate Sequence (CM) | VL or VL CDRs | VH or VH CDRs |
|---|---|---|---|
| | ISSGLLSGRSDYH (SEQ ID NO: 687) | | |
| | ISSGLLSGRSDNP (SEQ ID NO: 638) | | |
| | ISSGLLSGRSANP (SEQ ID NO: 639) | | |
| | ISSGLLSGRSANI (SEQ ID NO: 690) | | |
| | AVGLLAPPGGLSGRSDDH (SEQ ID NO: 691) | | |
| | AVGLLAPPGGLSGRSDIH (SEQ ID NO: 692) | | |
| | AVGLLAPPGGLSGRSDQH (SEQ ID NO: 693) | | |
| | AVGLLAPPGGLSGRSDTH (SEQ ID NO: 694) | | |
| | AVGLLAPPGGLSGRSDYH (SEQ ID NO: 695) | | |
| | AVGLLAPPGGLSGRSDNP (SEQ ID NO: 696) | | |
| | AVGLLAPPGGLSGRSANP (SEQ ID NO: 697) | | |
| | AVGLLAPPGGLSGRSANI (SEQ ID NO: 698) | | |
| | ISSGLLSGRSDNI (SEQ ID NO: 713) | | |
| | AVGLLAPPGGLSGRSDNI (SEQ ID NO: 714) | | |
| | GLSGRSDNHGGAVGLLAPP (SEQ ID NO: 807) | | |
| | GLSGRSDNHGGVHMPLGFLGP (SEQ ID NO: 808) | | |

In some embodiments, an activatable antibody of the present disclosure includes one or more polypeptides that include the combination of sequences selected from Table D or Table E, where the polypeptide includes a combination of a masking sequence selected from the column titled "Mask Sequence (MM)" of Table D or Table E, a substrate sequence from the column titled "Substrate Sequence (CM)" of Table D or Table E, a light chain variable domain or light chain CDRs from the column titled "VL or VL CDRs" or "VL CDRs SEQ ID NOs" of Table D or Table E, and a heavy chain variable domain or heavy chain CDRs from the column titled "VH or VH CDRs" or "VH CDRs SEQ ID Nos" of Table D or Table E. For example, an activatable antibody of the present disclosure may include the amino acid sequences of combination no. 54, which includes the masking sequence of SEQ ID NO: 17, the substrate sequence of SEQ ID NO: 412, a light chain variable domain that includes the VL CDR sequences of SEQ ID NOS: 12, 14, and 15, and a heavy chain variable domain that includes the VH CDR sequences of 9, 10, and 11. Therefore, an activatable antibody that includes at least the combination of sequences in any given row of Table D is described herein. Similarly, any combination of a mask sequence (MM), a substrate sequence (CM), a light chain variable domain sequence or light chain variable domain CDR sequences, and a heavy chain variable domain sequence or heavy chain variable domain CDR sequences of Table E is described herein. An activatable antibody that includes at least any combination of a masking sequence, a substrate sequence, a variable heavy chain or variable heavy chain CDRs, and a variable light chain or variable light chain CDRs selected from the corresponding columns Table D or Table E is also described herein. In some exemplary embodiments, an activatable antibody that includes at least the combination of sequences in any given row of Table D or any combination of a mask sequence (MM), a substrate sequence (CM), a light chain variable domain sequence or light chain variable domain CDR sequences, and a heavy chain variable domain sequence or heavy chain variable domain CDR sequences of Table E can be combined with one or more toxins, including a dolastatin or a derivative thereof, an auristatin or a derivative thereof, a maytansinoid or a derivative thereof, a duocarmycin or a derivative thereof, a calicheamicin or a derivative thereof, or a pyrrolobenzodiazepine or a derivative thereof. In some exemplary embodiments, an activatable antibody that includes at least the combination of sequences in any given row of Table D or any combination of a mask sequence (MM), a substrate sequence (CM), a light chain variable domain sequence or light chain variable domain CDR sequences, and a heavy chain variable domain sequence or heavy chain variable domain CDR sequences of Table E can be combined with one or more toxins, including auristatin E, monomethyl auristatin F (MMAF), monomethyl auristatin E (MMAE), monomethyl auristatin D (MMAD), maytansinoid DM4, maytansinoid DM1, a pyrrolobenzodiazepine, a pyrrolobenzodiazepine dimer, and/or a duocarmycin.

Any of the combinations in Table D or Table E as described above can be combined with human immunoglobulin constant regions to result in fully human IgGs including IgG1, IgG2, IgG4 or mutated constant regions to result in human IgGs with altered functions such as IgG1 N297A, IgG1 N297Q, or IgG4 S228P. The combinations described in Table D or Table E are not limited by the particular combinations shown in any given row, and thus may include any mask sequence from column 2 of Table D (or column 1 of Table E) combined with any substrate sequence from column 3 of Table D (or column 2 of Table E) combined with any VL sequence or set of VL CDR sequences from column 4 of Table D (or column 3 or Table E) combined with any VH sequence or set of VH CDR sequences from column 5 of Table D (or column 4 of Table E). In addition to the mask sequences disclosed in column 2 of Table D or column 1 of Table E, any mask sequence disclosed herein can be used in a combination. In addition to the substrate sequences disclosed in column 3 of Table D or column 2 of Table E, any CM disclosed herein can be used in a combination. In addition to the light chain variable region sequence or light chain CDR sequences disclosed in column 4 of Table D or column 3 of Table E, any light chain variable region sequence or light chain CDR sequences disclosed herein can be used in a combination. In addition to the heavy chain variable region sequence or heavy chain CDR sequences disclosed in column 5 of Table D or column 4 of Table E, any heavy chain variable region sequence or heavy chain CDR sequences disclosed herein can be used in a combination.

In some embodiments, the antibody drug conjugates (ADCs) and activatable antibody drug conjugates (AADCs) can include one or more polypeptides that include the combination of a light chain sequence or a light chain variable domain sequence, and a heavy chain sequence or a heavy chain variable domain sequence, a linker, and a toxin in a given row of Table F or any combination of a light chain sequence or a light chain variable domain sequence, and a heavy chain sequence or a heavy chain variable domain sequence, a linker, and a toxin of Table F.

TABLE F

Anti-CD71 ADC and Anti-CD71 Activatable ADC Combinations

| Comb. No. | Heavy Chain (HC) or HC Variable Region SEQ ID NO. | Light Chain (LC) or LC Variable Region SEQ ID NO. | Linker | Toxin |
| --- | --- | --- | --- | --- |
| 1 | 5 | 7 | vc | MMAD |
| 2 | 5 | 7 | PEG2-vc | MMAD |
| 3 | 5 | 7 | vc | MMAE |

TABLE F-continued

Anti-CD71 ADC and Anti-CD71 Activatable ADC Combinations

| Comb. No. | Heavy Chain (HC) or HC Variable Region SEQ ID NO. | Light Chain (LC) or LC Variable Region SEQ ID NO. | Linker | Toxin |
| --- | --- | --- | --- | --- |
| 4 | 5 | 7 | vc | duocarmycin |
| 5 | 5 | 7 | spdb | DM4 |
| 6 | 325 | 323 | vc | MMAD |
| 7 | 325 | 323 | PEG2-vc | MMAD |
| 8 | 325 | 323 | vc | MMAE |
| 9 | 325 | 323 | vc | duocarmycin |
| 10 | 325 | 323 | spdb | DM4 |
| 11 | 325 | 327 | vc | MMAD |
| 12 | 325 | 327 | PEG2-vc | MMAD |
| 13 | 325 | 327 | vc | MMAE |
| 14 | 325 | 327 | vc | duocarmycin |
| 15 | 325 | 327 | spdb | DM4 |
| 16 | 5 | 810 | vc | MMAD |
| 17 | 5 | 810 | PEG2-vc | MMAD |
| 18 | 5 | 810 | vc | MMAE |
| 19 | 5 | 810 | vc | duocarmycin |
| 20 | 5 | 810 | spdb | DM4 |
| 21 | 325 | 329 | vc | MMAD |
| 22 | 325 | 329 | PEG2-vc | MMAD |
| 23 | 325 | 329 | vc | MMAE |
| 24 | 325 | 329 | vc | duocarmycin |
| 25 | 325 | 329 | spdb | DM4 |
| 26 | 5 | 812 | vc | MMAD |
| 27 | 5 | 812 | PEG2-vc | MMAD |
| 28 | 5 | 812 | vc | MMAE |
| 29 | 5 | 812 | vc | duocarmycin |
| 30 | 5 | 812 | spdb | DM4 |
| 31 | 325 | 331 | vc | MMAD |
| 32 | 325 | 331 | PEG2-vc | MMAD |
| 33 | 325 | 331 | vc | MMAE |
| 34 | 325 | 331 | vc | duocarmycin |
| 35 | 325 | 331 | spdb | DM4 |
| 36 | 5 | 814 | vc | MMAD |
| 37 | 5 | 814 | PEG2-vc | MMAD |
| 38 | 5 | 814 | vc | MMAE |
| 39 | 5 | 814 | vc | duocarmycin |
| 40 | 5 | 814 | spdb | DM4 |
| 41 | 325 | 333 | vc | MMAD |
| 42 | 325 | 333 | PEG2-vc | MMAD |
| 43 | 325 | 333 | vc | MMAE |
| 44 | 325 | 333 | vc | duocarmycin |
| 45 | 325 | 333 | spdb | DM4 |
| 46 | 5 | 816 | vc | MMAD |
| 47 | 5 | 816 | PEG2-vc | MMAD |
| 48 | 5 | 816 | vc | MMAE |
| 49 | 5 | 816 | vc | duocarmycin |
| 50 | 5 | 816 | spdb | DM4 |
| 51 | 325 | 335 | vc | MMAD |
| 52 | 325 | 335 | PEG2-vc | MMAD |
| 53 | 325 | 335 | vc | MMAE |
| 54 | 325 | 335 | vc | duocarmycin |
| 55 | 325 | 335 | spdb | DM4 |
| 56 | 5 | 818 | vc | MMAD |
| 57 | 5 | 818 | PEG2-vc | MMAD |
| 58 | 5 | 818 | vc | MMAE |
| 59 | 5 | 818 | vc | duocarmycin |
| 60 | 5 | 818 | spdb | DM4 |
| 61 | 325 | 337 | vc | MMAD |
| 62 | 325 | 337 | PEG2-vc | MMAD |
| 63 | 325 | 337 | vc | MMAE |
| 64 | 325 | 337 | vc | duocarmycin |
| 65 | 325 | 337 | spdb | DM4 |
| 66 | 5 | 820 | vc | MMAD |
| 67 | 5 | 820 | PEG2-vc | MMAD |
| 68 | 5 | 820 | vc | MMAE |
| 69 | 5 | 820 | vc | duocarmycin |
| 70 | 5 | 820 | spdb | DM4 |
| 71 | 325 | 673 | vc | MMAD |
| 72 | 325 | 673 | PEG2-vc | MMAD |
| 73 | 325 | 673 | vc | MMAE |
| 74 | 325 | 673 | vc | duocarmycin |
| 75 | 325 | 673 | spdb | DM4 |
| 76 | 5 | 824 | vc | MMAD |

TABLE F-continued

Anti-CD71 ADC and Anti-CD71 Activatable ADC Combinations

| Comb. No. | Heavy Chain (HC) or HC Variable Region SEQ ID NO. | Light Chain (LC) or LC Variable Region SEQ ID NO. | Linker | Toxin |
|---|---|---|---|---|
| 77 | 5 | 824 | PEG2-vc | MMAD |
| 78 | 5 | 824 | vc | MMAE |
| 79 | 5 | 824 | vc | duocarmycin |
| 80 | 5 | 824 | spdb | DM4 |
| 81 | 325 | 702 | vc | MMAD |
| 82 | 325 | 702 | PEG2-vc | MMAD |
| 83 | 325 | 702 | vc | MMAE |
| 84 | 325 | 702 | vc | duocarmycin |
| 85 | 325 | 702 | spdb | DM4 |
| 86 | 5 | 826 | vc | MMAD |
| 87 | 5 | 826 | PEG2-vc | MMAD |
| 88 | 5 | 826 | vc | MMAE |
| 89 | 5 | 826 | vc | duocarmycin |
| 90 | 5 | 826 | spdb | DM4 |
| 91 | 325 | 671 | vc | MMAD |
| 92 | 325 | 671 | PEG2-vc | MMAD |
| 93 | 325 | 671 | vc | MMAE |
| 94 | 325 | 671 | vc | duocarmycin |
| 95 | 325 | 671 | spdb | DM4 |
| 96 | 5 | 822 | vc | MMAD |
| 97 | 5 | 822 | PEG2-vc | MMAD |
| 98 | 5 | 822 | vc | MMAE |
| 99 | 5 | 822 | vc | duocarmycin |
| 100 | 5 | 822 | spdb | DM4 |
| 101 | 325 | 704 | vc | MMAD |
| 102 | 325 | 704 | PEG2-vc | MMAD |
| 103 | 325 | 704 | vc | MMAE |
| 104 | 325 | 704 | vc | duocarmycin |
| 105 | 325 | 704 | spdb | DM4 |
| 106 | 5 | 828 | vc | MMAD |
| 107 | 5 | 828 | PEG2-vc | MMAD |
| 108 | 5 | 828 | vc | MMAE |
| 109 | 5 | 828 | vc | duocarmycin |
| 110 | 5 | 828 | spdb | DM4 |
| 111 | 325 | 706 | vc | MMAD |
| 112 | 325 | 706 | PEG2-vc | MMAD |
| 113 | 325 | 706 | vc | MMAE |
| 114 | 325 | 706 | vc | duocarmycin |
| 115 | 325 | 706 | spdb | DM4 |
| 116 | 5 | 830 | vc | MMAD |
| 117 | 5 | 830 | PEG2-vc | MMAD |
| 118 | 5 | 830 | vc | MMAE |
| 119 | 5 | 830 | vc | duocarmycin |
| 120 | 5 | 830 | spdb | DM4 |
| 121 | 325 | 708 | vc | MMAD |
| 122 | 325 | 708 | PEG2-vc | MMAD |
| 123 | 325 | 708 | vc | MMAE |
| 124 | 325 | 708 | vc | duocarmycin |
| 125 | 325 | 708 | spdb | DM4 |
| 126 | 5 | 832 | vc | MMAD |
| 127 | 5 | 832 | PEG2-vc | MMAD |
| 128 | 5 | 832 | vc | MMAE |
| 129 | 5 | 832 | vc | duocarmycin |
| 130 | 5 | 832 | spdb | DM4 |
| 131 | 325 | 710 | vc | MMAD |
| 132 | 325 | 710 | PEG2-vc | MMAD |
| 133 | 325 | 710 | vc | MMAE |
| 134 | 325 | 710 | vc | duocarmycin |
| 135 | 325 | 710 | spdb | DM4 |
| 136 | 5 | 834 | vc | MMAD |
| 137 | 5 | 834 | PEG2-vc | MMAD |
| 138 | 5 | 834 | vc | MMAE |
| 139 | 5 | 834 | vc | duocarmycin |
| 140 | 5 | 834 | spdb | DM4 |
| 141 | 325 | 712 | vc | MMAD |
| 142 | 325 | 712 | PEG2-vc | MMAD |
| 143 | 325 | 712 | vc | MMAE |
| 144 | 325 | 712 | vc | duocarmycin |
| 145 | 325 | 712 | spdb | DM4 |
| 146 | 5 | 836 | vc | MMAD |
| 147 | 5 | 836 | PEG2-vc | MMAD |
| 148 | 5 | 836 | vc | MMAE |
| 149 | 5 | 836 | vc | duocarmycin |
| 150 | 5 | 836 | spdb | DM4 |
| 151 | 325 | 323 | vc | MMAD |
| 152 | 325 | 323 | PEG2-vc | MMAD |
| 153 | 325 | 323 | vc | MMAE |
| 154 | 325 | 323 | vc | duocarmycin |
| 155 | 325 | 323 | spdb | DM4 |
| 156 | 325 | 650 | vc | MMAD |
| 157 | 325 | 650 | PEG2-vc | MMAD |
| 158 | 325 | 650 | vc | MMAE |
| 159 | 325 | 650 | vc | duocarmycin |
| 160 | 325 | 650 | spdb | DM4 |
| 161 | 5 | 809 | vc | MMAD |
| 162 | 5 | 809 | PEG2-vc | MMAD |
| 163 | 5 | 809 | vc | MMAE |
| 164 | 5 | 809 | vc | duocarmycin |
| 165 | 5 | 809 | spdb | DM4 |
| 166 | 325 | 652 | vc | MMAD |
| 167 | 325 | 652 | PEG2-vc | MMAD |
| 168 | 325 | 652 | vc | MMAE |
| 169 | 325 | 652 | vc | duocarmycin |
| 170 | 325 | 652 | spdb | DM4 |
| 171 | 5 | 811 | vc | MMAD |
| 172 | 5 | 811 | PEG2-vc | MMAD |
| 173 | 5 | 811 | vc | MMAE |
| 174 | 5 | 811 | vc | duocarmycin |
| 175 | 5 | 811 | spdb | DM4 |
| 176 | 325 | 654 | vc | MMAD |
| 177 | 325 | 654 | PEG2-vc | MMAD |
| 178 | 325 | 654 | vc | MMAE |
| 179 | 325 | 654 | vc | duocarmycin |
| 180 | 325 | 654 | spdb | DM4 |
| 181 | 5 | 813 | vc | MMAD |
| 182 | 5 | 813 | PEG2-vc | MMAD |
| 183 | 5 | 813 | vc | MMAE |
| 184 | 5 | 813 | vc | duocarmycin |
| 185 | 5 | 813 | spdb | DM4 |
| 186 | 325 | 656 | vc | MMAD |
| 187 | 325 | 656 | PEG2-vc | MMAD |
| 188 | 325 | 656 | vc | MMAE |
| 189 | 325 | 656 | vc | duocarmycin |
| 190 | 325 | 656 | spdb | DM4 |
| 191 | 5 | 815 | vc | MMAD |
| 192 | 5 | 815 | PEG2-vc | MMAD |
| 193 | 5 | 815 | vc | MMAE |
| 194 | 5 | 815 | vc | duocarmycin |
| 195 | 5 | 815 | spdb | DM4 |
| 196 | 325 | 658 | vc | MMAD |
| 197 | 325 | 658 | PEG2-vc | MMAD |
| 198 | 325 | 658 | vc | MMAE |
| 199 | 325 | 658 | vc | duocarmycin |
| 200 | 325 | 658 | spdb | DM4 |
| 201 | 5 | 817 | vc | MMAD |
| 202 | 5 | 817 | PEG2-vc | MMAD |
| 203 | 5 | 817 | vc | MMAE |
| 204 | 5 | 817 | vc | duocarmycin |
| 205 | 5 | 817 | spdb | DM4 |
| 206 | 325 | 660 | vc | MMAD |
| 207 | 325 | 660 | PEG2-vc | MMAD |
| 208 | 325 | 660 | vc | MMAE |
| 209 | 325 | 660 | vc | duocarmycin |
| 210 | 325 | 660 | spdb | DM4 |
| 211 | 5 | 819 | vc | MMAD |
| 212 | 5 | 819 | PEG2-vc | MMAD |
| 213 | 5 | 819 | vc | MMAE |
| 214 | 5 | 819 | vc | duocarmycin |
| 215 | 5 | 819 | spdb | DM4 |
| 216 | 325 | 672 | vc | MMAD |
| 217 | 325 | 672 | PEG2-vc | MMAD |
| 218 | 325 | 672 | vc | MMAE |
| 219 | 325 | 672 | vc | duocarmycin |
| 220 | 325 | 672 | spdb | DM4 |
| 221 | 5 | 823 | vc | MMAD |
| 222 | 5 | 823 | PEG2-vc | MMAD |

TABLE F-continued

Anti-CD71 ADC and Anti-CD71 Activatable ADC Combinations

| Comb. No. | Heavy Chain (HC) or HC Variable Region SEQ ID NO. | Light Chain (LC) or LC Variable Region SEQ ID NO. | Linker | Toxin |
|---|---|---|---|---|
| 223 | 5 | 823 | vc | MMAE |
| 224 | 5 | 823 | vc | duocarmycin |
| 225 | 5 | 823 | spdb | DM4 |
| 226 | 325 | 701 | vc | MMAD |
| 227 | 325 | 701 | PEG2-vc | MMAD |
| 228 | 325 | 701 | vc | MMAE |
| 229 | 325 | 701 | vc | duocarmycin |
| 230 | 325 | 701 | spdb | DM4 |
| 231 | 5 | 825 | vc | MMAD |
| 232 | 5 | 825 | PEG2-vc | MMAD |
| 233 | 5 | 825 | vc | MMAE |
| 234 | 5 | 825 | vc | duocarmycin |
| 235 | 5 | 825 | spdb | DM4 |
| 236 | 325 | 670 | vc | MMAD |
| 237 | 325 | 670 | PEG2-vc | MMAD |
| 238 | 325 | 670 | vc | MMAE |
| 239 | 325 | 670 | vc | duocarmycin |
| 240 | 325 | 670 | spdb | DM4 |
| 241 | 5 | 821 | vc | MMAD |
| 242 | 5 | 821 | PEG2-vc | MMAD |
| 243 | 5 | 821 | vc | MMAE |
| 244 | 5 | 821 | vc | duocarmycin |
| 245 | 5 | 821 | spdb | DM4 |
| 246 | 325 | 703 | vc | MMAD |
| 247 | 325 | 703 | PEG2-vc | MMAD |
| 248 | 325 | 703 | vc | MMAE |
| 249 | 325 | 703 | vc | duocarmycin |
| 250 | 325 | 703 | spdb | DM4 |
| 251 | 5 | 827 | vc | MMAD |
| 252 | 5 | 827 | PEG2-vc | MMAD |
| 253 | 5 | 827 | vc | MMAE |
| 254 | 5 | 827 | vc | duocarmycin |
| 255 | 5 | 827 | spdb | DM4 |
| 256 | 325 | 705 | vc | MMAD |
| 257 | 325 | 705 | PEG2-vc | MMAD |
| 258 | 325 | 705 | vc | MMAE |
| 259 | 325 | 705 | vc | duocarmycin |
| 260 | 325 | 705 | spdb | DM4 |
| 261 | 5 | 829 | vc | MMAD |
| 262 | 5 | 829 | PEG2-vc | MMAD |
| 263 | 5 | 829 | vc | MMAE |
| 264 | 5 | 829 | vc | duocarmycin |
| 265 | 5 | 829 | spdb | DM4 |
| 266 | 325 | 707 | vc | MMAD |
| 267 | 325 | 707 | PEG2-vc | MMAD |
| 268 | 325 | 707 | vc | MMAE |
| 269 | 325 | 707 | vc | duocarmycin |
| 270 | 325 | 707 | spdb | DM4 |
| 271 | 5 | 831 | vc | MMAD |
| 272 | 5 | 831 | PEG2-vc | MMAD |
| 273 | 5 | 831 | vc | MMAE |
| 274 | 5 | 831 | vc | duocarmycin |
| 275 | 5 | 831 | spdb | DM4 |
| 276 | 325 | 709 | vc | MMAD |
| 277 | 325 | 709 | PEG2-vc | MMAD |
| 278 | 325 | 709 | vc | MMAE |
| 279 | 325 | 709 | vc | duocarmycin |
| 280 | 325 | 709 | spdb | DM4 |
| 281 | 5 | 833 | vc | MMAD |
| 282 | 5 | 833 | PEG2-vc | MMAD |
| 283 | 5 | 833 | vc | MMAE |
| 284 | 5 | 833 | vc | duocarmycin |
| 285 | 5 | 833 | spdb | DM4 |
| 286 | 325 | 711 | vc | MMAD |
| 287 | 325 | 711 | PEG2-vc | MMAD |
| 288 | 325 | 711 | vc | MMAE |
| 289 | 325 | 711 | vc | duocarmycin |
| 290 | 325 | 711 | spdb | DM4 |
| 291 | 5 | 835 | vc | MMAD |
| 292 | 5 | 835 | PEG-2-vc | MMAD |
| 293 | 5 | 835 | vc | MMAE |
| 294 | 5 | 835 | vc | duocarmycin |
| 295 | 5 | 835 | spdb | DM4 |

An antibody drug conjugate (ADC) of the present disclosure or activatable antibody drug conjugate (AADC) of the present disclosure may include one or more polypeptides that include the combination of amino acid sequences, a linker, and a toxin listed in a given row of Table F. Therefore, an activatable antibody drug conjugate (ADC) of the present disclosure or activatable antibody drug conjugate (AADC) of the present disclosure that includes the combination of amino acid sequences, a linker, and a toxin listed in a given row or provided as a specific combination is described herein. For example, an activatable antibody drug conjugate of the present disclosure may include the amino acid sequences of combination no. 45, which includes a heavy chain comprising the amino acid sequence of SEQ ID NO: 325, a light chain comprising the amino acid sequence of SEQ ID NO: 333, and a spdb-DM4 linker-toxin. In another example of the AADCs disclosed and described herein, an activatable antibody drug conjugate of the present disclosure may include the amino acid sequences of combination no. 33, which includes a heavy chain comprising the amino acid sequence of SEQ ID NO: 325, a light chain comprising the amino acid sequence of SEQ ID NO: 331, and a vc-MMAE linker-toxin.

Any of the combinations in Table F that list a heavy chain and light chain variable region can be combined with human immunoglobulin constant regions to result in fully human IgGs including IgG1, IgG2, IgG4 or mutated constant regions to result in human IgGs with altered functions such as IgG1 N297A, IgG1 N297Q, or IgG4 S228P. The combinations described in Table F are not limited by the particular combinations shown in any given row, and thus can include any heavy chain sequence or heavy chain variable region sequence from column 2 of Table F combined with any light chain sequence or light chain variable region sequence from column 3 of Table F combined with any linker from column 4 combined with any toxin from column 5. In addition to the heavy chain sequences or heavy chain variable region sequences listed in column 2, any heavy chain sequence or heavy chain variable region sequence disclosed herein can be used in a combination. In addition to the light chain sequences or light chain variable region sequences listed in column 3, any light chain sequence or light chain variable region sequence disclosed herein can be used in a combination. In addition to the linkers listed in column 4, any linker disclosed herein can be used in a combination. In addition to the toxins listed in column 5, any toxin disclosed herein can be used in a combination.

In some embodiments, the serum half-life of the activatable antibody is longer than that of the corresponding antibody; e.g., the pK of the activatable antibody is longer than that of the corresponding antibody. In some embodiments, the serum half-life of the activatable antibody is similar to that of the corresponding antibody. In some embodiments, the serum half-life of the activatable antibody is at least 15 days when administered to an organism. In some embodiments, the serum half-life of the activatable antibody is at least 12 days when administered to an organism. In some embodiments, the serum half-life of the activatable antibody is at least 11 days when administered to an organism. In some embodiments, the serum half-life of the activatable antibody is at least 10 days when administered to an organism. In some embodiments, the serum half-life of the activatable antibody is at least 9 days when administered to an organism. In some embodiments, the serum half-life of the activatable antibody is at least 8 days when administered to an organism. In some embodiments, the serum half-life of the activatable antibody is at least 7 days when administered to an organism. In some embodiments, the serum half-life of the activatable antibody is at least 6 days when administered to an organism. In some embodiments, the serum half-life of the activatable antibody is at least 5 days when administered to an organism. In some embodiments, the serum half-life of the activatable antibody is at least 4 days when administered to an organism. In some embodiments, the serum half-life of the activatable antibody is at least 3 days when administered to an organism. In some embodiments, the serum half-life of the activatable antibody is at least 2 days when administered to an organism. In some embodiments, the serum half-life of the activatable antibody is at least 24 hours when administered to an organism. In some embodiments, the serum half-life of the activatable antibody is at least 20 hours when administered to an organism. In some embodiments, the serum half-life of the activatable antibody is at least 18 hours when administered to an organism. In some embodiments, the serum half-life of the activatable antibody is at least 16 hours when administered to an organism. In some embodiments, the serum half-life of the activatable antibody is at least 14 hours when administered to an organism. In some embodiments, the serum half-life of the activatable antibody is at least 12 hours when administered to an organism. In some embodiments, the serum half-life of the activatable antibody is at least 10 hours when administered to an organism. In some embodiments, the serum half-life of the activatable antibody is at least 8 hours when administered to an organism. In some embodiments, the serum half-life of the activatable antibody is at least 6 hours when administered to an organism. In some embodiments, the serum half-life of the activatable antibody is at least 4 hours when administered to an organism. In some embodiments, the serum half-life of the activatable antibody is at least 3 hours when administered to an organism.

In some embodiments, the activatable anti-CD71 antibody and/or conjugated activatable anti-CD71 antibody is monospecific. In some embodiments, the activatable anti-CD71 antibody and/or conjugated activatable anti-CD71 antibody is multispecific, e.g., by way of non-limiting example, bispecific or trifunctional. In some embodiments, the activatable anti-CD71 antibody and/or conjugated activatable anti-CD71 antibody is formulated as part of a pro-Bispecific T Cell Engager (BITE) molecule. In some embodiments, the activatable anti-CD71 antibody and/or conjugated activatable anti-CD71 antibody is formulated as part of a pro-Chimeric Antigen Receptor (CAR) modified T cell or other engineered receptor.

In some embodiments, the activatable antibody or antigen-binding fragment thereof is incorporated in a multispecific activatable antibody or antigen-binding fragment thereof, where at least one arm of the multispecific activatable antibody specifically binds CD71. In some embodiments, the activatable antibody or antigen-binding fragment thereof is incorporated in a bispecific antibody or antigen-binding fragment thereof, where at least one arm of the bispecific activatable antibody specifically binds CD71.

In some embodiments, the anti-CD71 antibodies, conjugated anti-CD71 antibodies, activatable anti-CD71 antibodies and/or conjugated activatable anti-CD71 antibodies described herein are used in conjunction with one or more additional agents or a combination of additional agents. Suitable additional agents include current pharmaceutical and/or surgical therapies for an intended application, such as, for example, cancer. For example, the anti-CD71 antibodies, conjugated anti-CD71 antibodies, activatable anti-CD71 antibodies and/or conjugated activatable anti-CD71 antibodies can be used in conjunction with an additional chemotherapeutic or anti-neoplastic agent.

In some embodiments, the additional agent(s) is a chemotherapeutic agent, such as a chemotherapeutic agent selected from the group consisting of docetaxel, paclitaxel, abraxane (i.e., albumin-conjugated paclitaxel), doxorubicin, oxaliplatin, carboplatin, cisplatin, irinotecan, and gemcitabine.

In some embodiments, the additional agent(s) is a checkpoint inhibitor, a kinase inhibitor, an agent targeting inhibitors in the tumor microenvironment, and/or a T cell or NK agonist. In some embodiments, the additional agent(s) is radiation therapy, alone or in combination with another additional agent(s) such as a chemotherapeutic or anti-neoplastic agent. In some embodiments, the additional agent(s) is a vaccine, an oncovirus, and/or a DC-activating agent such as, by way of non-limiting example, a toll-like receptor (TLR) agonist and/or α-CD40. In some embodiments, the additional agent(s) is a tumor-targeted antibody designed to kill the tumor via ADCC or via direct conjugation to a toxin (e.g., an antibody drug conjugate (ADC).

In some embodiments, the checkpoint inhibitor is an inhibitor of a target selected from the group consisting of CTLA-4, LAG-3, PD-1, CD71, TIGIT, TIM-3, B7H4, and Vista. In some embodiments, the kinase inhibitor is selected from the group consisting of B-RAFi, MEKi, and Btk inhibitors, such as ibrutinib. In some embodiments, the kinase inhibitor is crizotinib. In some embodiments, the tumor microenvironment inhibitor is selected from the group consisting of an IDO inhibitor, an α-CSF1R inhibitor, an α-CCR4 inhibitor, a TGF-beta, a myeloid-derived suppressor cell, or a T-regulatory cell. In some embodiments, the agonist is selected from the group consisting of Ox40, GITR, CD137, ICOS, CD27, and HVEM.

In some embodiments, the inhibitor is a CTLA-4 inhibitor. In some embodiments, the inhibitor is a LAG-3 inhibitor. In some embodiments, the inhibitor is a PD-1 inhibitor. In some embodiments, the inhibitor is a CD71 inhibitor. In some embodiments, the inhibitor is a TIGIT inhibitor. In some embodiments, the inhibitor is a TIM-3 inhibitor. In some embodiments, the inhibitor is a B7H4 inhibitor. In some embodiments, the inhibitor is a Vista inhibitor. In some embodiments, the inhibitor is a B-RAFi inhibitor. In some embodiments, the inhibitor is a MEKi inhibitor. In some embodiments, the inhibitor is a Btk inhibitor. In some embodiments, the inhibitor is ibrutinib. In some embodiments, the inhibitor is crizotinib. In some embodiments, the inhibitor is an IDO inhibitor. In some embodiments, the inhibitor is an α-CSF1R inhibitor. In some embodiments, the inhibitor is an α-CCR4 inhibitor. In some embodiments, the inhibitor is a TGF-beta. In some embodiments, the inhibitor is a myeloid-derived suppressor cell. In some embodiments, the inhibitor is a T-regulatory cell.

In some embodiments, the agonist is Ox40. In some embodiments, the agonist is GITR. In some embodiments, the agonist is CD137. In some embodiments, the agonist is ICOS. In some embodiments, the agonist is CD27. In some embodiments, the agonist is HVEM.

In some embodiments, the anti-CD71 antibody, conjugated antibody, activatable antibody and/or conjugated activatable antibody is administered during and/or after treatment in combination with one or more additional agents such as, for example, a chemotherapeutic agent, an anti-inflammatory agent, and/or a an immunosuppressive agent. In some embodiments, the anti-CD71 antibody, conjugated anti-CD71 antibody, activatable anti-CD71 antibody and/or conjugated activatable anti-CD71 antibody and the additional agent are formulated into a single therapeutic composition, and the anti-CD71 antibody, conjugated anti-CD71 antibody, activatable anti-CD71 antibody and/or conjugated activatable anti-CD71 antibody and additional agent are administered simultaneously. Alternatively, the anti-CD71 antibody, conjugated anti-CD71 antibody, activatable anti-CD71 antibody and/or conjugated activatable anti-CD71 antibody and additional agent are separate from each other, e.g., each is formulated into a separate therapeutic composition, and the anti-CD71 antibody, conjugated anti-CD71 antibody, activatable anti-CD71 antibody and/or conjugated activatable anti-CD71 antibody and the additional agent are administered simultaneously, or the anti-CD71 antibody, conjugated anti-CD71 antibody, activatable anti-CD71 antibody and/or conjugated activatable anti-CD71 antibody and the additional agent are administered at different times during a treatment regimen. For example, the anti-CD71 antibody, conjugated anti-CD71 antibody, activatable anti-CD71 antibody and/or conjugated activatable anti-CD71 antibody is administered prior to the administration of the additional agent, the anti-CD71 antibody, conjugated anti-CD71 antibody, activatable anti-CD71 antibody and/or conjugated activatable anti-CD71 antibody is administered subsequent to the administration of the additional agent, or the anti-CD71 antibody, conjugated anti-CD71 antibody, activatable anti-CD71 antibody and/or conjugated activatable anti-CD71 antibody and the additional agent are administered in an alternating fashion. As described herein, the anti-CD71 antibody, conjugated anti-CD71 antibody, activatable anti-CD71 antibody and/or conjugated activatable anti-CD71 antibody and additional agent are administered in single doses or in multiple doses.

In some embodiments, the anti-CD71 antibody, conjugated anti-CD71 antibody, activatable anti-CD71 antibody and/or conjugated activatable anti-CD71 antibody and the additional agent(s) are administered simultaneously. For example, the anti-CD71 antibody, conjugated anti-CD71 antibody, activatable anti-CD71 antibody and/or conjugated activatable anti-CD71 antibody and the additional agent(s) can be formulated in a single composition or administered as two or more separate compositions. In some embodiments, the anti-CD71 antibody, conjugated anti-CD71 antibody, activatable anti-CD71 antibody and/or conjugated activatable anti-CD71 antibody and the additional agent(s) are administered sequentially, or the anti-CD71 antibody, conjugated anti-CD71 antibody, activatable anti-CD71 antibody and/or conjugated activatable anti-CD71 antibody and the additional agent are administered at different times during a treatment regimen.

In some embodiments, the anti-CD71 antibody, conjugated anti-CD71 antibody, activatable anti-CD71 antibody and/or conjugated activatable anti-CD71 antibody is administered during and/or after treatment in combination with one or more additional agents such as, by way of non-limiting example, a chemotherapeutic agent, an anti-inflammatory agent, and/or an immunosuppressive agent, such as an alkylating agent, an anti-metabolite, an anti-microtubule agent, a topoisomerase inhibitor, a cytotoxic antibiotic, and/or any other nucleic acid damaging agent. In some embodiments, the additional agent is a taxane, such as paclitaxel (e.g., Abraxane®). In some embodiments, the additional agent is an anti-metabolite, such as gemcitabine. In some embodiments, the additional agent is an alkylating agent, such as platinum-based chemotherapy, such as carboplatin or cisplatin. In some embodiments, the additional agent is a targeted agent, such as a kinase inhibitor, e.g., sorafenib or erlotinib. In some embodiments, the additional agent is a targeted agent, such as another antibody, e.g., a monoclonal antibody (e.g., bevacizumab), a bispecific antibody, or a multispecific antibody. In some embodiments, the additional agent is a proteosome inhibitor, such as bortezomib or carfilzomib. In some embodiments, the additional agent is an immune modulating agent, such as lenolidominde or IL-2. In some embodiments, the additional agent is radiation. In some embodiments, the additional agent is an agent considered standard of care by those skilled in the art. In some embodiments, the additional agent is a chemotherapeutic agent well known to those skilled in the art.

In some embodiments, the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof. In some embodiments the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof against the same target as the first antibody or antigen-binding fragment thereof, the first conjugated antibody or antigen-binding fragment thereof, activatable antibody or antigen-binding fragment thereof and/or a conjugated activatable antibody or antigen-binding fragment thereof, e.g., against CD71. In some embodiments the additional agent is another antibody or antigen-binding fragment thereof, another conjugated antibody or antigen-binding fragment thereof, another activatable antibody or antigen-binding fragment thereof and/or another conjugated activatable antibody or antigen-binding fragment thereof against a target different than the target of the first antibody or antigen-binding fragment thereof, the first conjugated antibody or antigen-binding fragment thereof, activatable antibody or antigen-binding fragment thereof and/or a conjugated activatable antibody or antigen-binding fragment thereof.

As a non-limiting example, the antibody or antigen-binding fragment and/or the AB of an activatable antibody is a binding partner for any target listed in Table 1.

TABLE 1

Exemplary Targets

| | | | | | |
|---|---|---|---|---|---|
| 1-92-LFA-3 | CD52 | DL44 | HVEM | LIF-R | STEAP1 |
| Alpha-4 integrin | CD56 | DLK1 | Hyaluronidase | Lewis X | STEAP2 |

TABLE 1-continued

Exemplary Targets

| | | | | | |
|---|---|---|---|---|---|
| Alpha-V integrin | CD64 | DLL4 | ICOS | LIGHT | TAG-72 |
| alpha4beta1 integrin | CD70 | DPP-4 | IFNalpha | LRP4 | TAPA1 |
| alpha4beta7 integrin | CD71 | DSG1 | IFNbeta | LRRC26 | TGFbeta |
| AGR2 | CD74 | EGFR | IFNgamma | MCSP | TIGIT |
| Anti-Lewis-Y | | EGFRviii | IgE | Mesothelin | TIM-3 |
| Apelin J receptor | CD80 | Endothelin B receptor (ETBR) | IgE Receptor (FceRI) | MRP4 | TLR2 |
| APRIL | CD81 | ENPP3 | IGF | MUC1 | TLR4 |
| B7-H4 | CD86 | EpCAM | IGF1R | Mucin-16 (MUC16, CA-125) | TLR6 |
| BAFF | CD95 | EPHA2 | IL1B | Na/K ATPase | TLR7 |
| BTLA | CD117 | EPHB2 | IL1R | Neutrophil elastase | TLR8 |
| C5 complement | CD125 | ERBB3 | IL2 | NGF | TLR9 |
| C-242 | CD132 (IL-2RG) | F protein of RSV | IL11 | Nicastrin | TMEM31 |
| CA9 | CD133 | FAP | IL12 | Notch Receptors | TNFalpha |
| CA19-9 (Lewis a) | CD137 | FGF-2 | IL12p40 | Notch 1 | TNFR |
| Carbonic anhydrase 9 | CD138 | FGF8 | IL-12R, IL-12Rbeta1 | Notch 2 | TNFRS12A |
| CD2 | CD166 | FGFR1 | IL13 | Notch 3 | TRAIL-R1 |
| CD3 | CD172A | FGFR2 | IL13R | Notch 4 | TRAIL-R2 |
| CD6 | CD248 | FGFR3 | IL15 | NOV | Transferrin |
| CD9 | CDH6 | FGFR4 | IL17 | OSM-R | Transferrin receptor |
| CD11a | CEACAM5 (CEA) | Folate receptor | IL18 | OX-40 | TRK-A |
| CD19 | CEACAM6 (NCA-90) | GAL3ST1 | IL21 | PAR2 | TRK-B |
| CD20 | CLAUDIN-3 | G-CSF | IL23 | PDGF-AA | uPAR |
| CD22 | CLAUDIN-4 | G-CSFR | IL23R | PDGF-BB | VAP1 |
| CD24 | cMet | GD2 | IL27/IL27R (wsx1) | PDGFRalpha | VCAM-1 |
| CD25 | Collagen | GITR | IL29 | PDGFRbeta | VEGF |
| CD27 | Cripto | GLUT1 | IL-31R | PD-1 | VEGF-A |
| CD28 | CSFR | GLUT4 | IL31/IL31R | PD-L1 | VEGF-B |
| CD30 | CSFR-1 | GM-CSF | IL2R | PD-L2 | VEGF-C |
| CD33 | CTLA-4 | GM-CSFR | IL4 | Phosphatidyl-serine | VEGF-D |
| CD38 | CTGF | GP IIb/IIIa receptors | IL4R | P1GF | VEGFR1 |
| CD40 | CXCL10 | Gp130 | IL6, IL6R | PSCA | VEGFR2 |
| CD40L | CXCL13 | GPIIB/IIIA | Insulin Receptor | PSMA | VEGFR3 |
| CD41 | CXCR1 | GPNMB | Jagged Ligands | RAAG12 | VISTA |
| CD44 | CXCR2 | GRP78 | Jagged 1 | RAGE | WISP-1 |
| CD44v6 | | HER2/neu | Jagged 2 | SLC44A4 | WISP-2 |
| CD47 | CXCR4 | HGF | LAG-3 | Sphingosine 1 Phosphate | WISP-3 |
| CD51 | CYR61 | hGH | | | |

As a non-limiting example, the antibody or antigen-binding fragment and/or the AB of an activatable antibody is or is derived from an antibody listed in Table 2.

TABLE 2

Exemplary sources for Abs

| Antibody Trade Name (antibody name) | Target |
|---|---|
| Avastin ™ (bevacizumab) | VEGF |
| Lucentis ™ (ranibizumab) | VEGF |
| Erbitux ™ (cetuximab) | EGFR |
| Vectibix ™ (panitumumab) | EGFR |
| Remicade ™ (infliximab) | TNFα |
| Humira ™ (adalimumab) | TNFα |
| Tysabri ™ (natalizumab) | Integrinα4 |
| Simulect ™ (basiliximab) | IL2R |
| Soliris ™ (eculizumab) | Complement C5 |
| Raptiva ™ (efalizumab) | CD11a |
| Bexxar ™ (tositumomab) | CD20 |
| Zevalin ™ (ibritumomab tiuxetan) | CD20 |
| Rituxan ™ (rituximab) | CD20 |
| Ocrelizumab | CD20 |

TABLE 2-continued

Exemplary sources for Abs

| Antibody Trade Name (antibody name) | Target |
| --- | --- |
| Arzerra ™ (ofatumumab) | CD20 |
| Gazyva ™ (obinutuzumab) | CD20 |
| Zenapax ™ (daclizumab) | CD25 |
| Adcetris ™ (brentuximab vedotin) | CD30 |
| Myelotarg ™ (gemtuzumab) | CD33 |
| Mylotarg ™ (gemtuzumab ozogamicin) | CD33 |
| Campath ™ (alemtuzumab) | CD52 |
| ReoPro ™ (abiciximab) | Glycoprotein receptor IIb/IIIa |
| Xolair ™ (omalizumab) | IgE |
| Herceptin ™ (trastuzumab) | Her2 |
| Kadcyla ™ (trastuzumab emtansine) | Her2 |
| Synagis ™ (palivizumab) | F protein of RSV |
| (ipilimumab) | CTLA-4 |
| (tremelimumab) | CTLA-4 |
| Hu5c8 | CD40L |
| (pertuzumab) | Her2-neu |
| (ertumaxomab) | CD3/Her2-neu |
| Orencia ™ (abatacept) | CTLA-4 |
| (tanezumab) | NGF |
| (bavituximab) | Phosphatidylserine |
| (zalutumumab) | EGFR |
| (mapatumumab) | EGFR |
| (matuzumab) | EGFR |
| (nimotuzumab) | EGFR |
| ICR62 | EGFR |
| mAb 528 | EGFR |
| CH806 | EGFR |
| MDX-447 | EGFR/CD64 |
| (edrecolomab) | EpCAM |
| RAV12 | RAAG12 |
| huJ591 | PSMA |
| Enbrel ™ (etanercept) | TNF-R |
| Amevive ™ (alefacept) | 1-92-LFA-3 |
| Antril ™, Kineret ™ (ankinra) | IL-1Ra |
| GC1008 | TGFbeta |
| | Notch, e.g., Notch 1 |
| | Jagged 1 or Jagged 2 |
| (adecatumumab) | EpCAM |
| (figitumumab) | IGF1R |
| (tocilizumab) | IL-6 receptor |
| Stelara ™ (ustekinumab) | IL-12/IL-23 |
| Prolia ™ (denosumab) | RANKL |

In some embodiments, the additional antibody or antigen binding fragment thereof, conjugated antibody or antigen binding fragment thereof, activatable antibody or antigen binding fragment thereof, and/or conjugated activatable antibody or antigen binding fragment thereof is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, the additional antibody or antigen binding fragment thereof, conjugated antibody or antigen binding fragment thereof, activatable antibody or antigen binding fragment thereof, and/or conjugated activatable antibody or antigen binding fragment thereof is a mouse, other rodent, chimeric, humanized or fully human monoclonal antibody.

The disclosure also provides methods of producing an anti-CD71 antibody and/or activatable anti-CD71 antibody polypeptide by culturing a cell under conditions that lead to expression of the polypeptide, wherein the cell comprises an isolated nucleic acid molecule encoding an antibody and/or an activatable antibody described herein, and/or vectors that include these isolated nucleic acid sequences. The disclosure provides methods of producing an antibody and/or activatable antibody by culturing a cell under conditions that lead to expression of the antibody and/or activatable antibody, wherein the cell comprises an isolated nucleic acid molecule encoding an antibody and/or an activatable antibody described herein, and/or vectors that include these isolated nucleic acid sequences.

The invention also provides a method of manufacturing activatable antibodies that in an activated state binds CD71 by (a) culturing a cell comprising a nucleic acid construct that encodes the activatable antibody under conditions that lead to expression of the activatable antibody, wherein the activatable antibody comprises a masking moiety (MM), a cleavable moiety (CM), and an antibody or an antigen binding fragment thereof (AB) that specifically binds CD71, (i) wherein the CM is a polypeptide that functions as a substrate for a protease; and (ii) wherein the CM is positioned in the activatable antibody such that, when the activatable antibody is in an uncleaved state, the MM interferes with specific binding of the AB to CD71 and in a cleaved state the MM does not interfere or compete with specific binding of the AB to CD71, and (b) recovering the activatable antibody. Suitable AB, MM, and/or CM include any of the AB, MM, and/or CM disclosed herein.

In some embodiments, the activatable antibody in the uncleaved state has the structural arrangement from N-terminus to C-terminus as follows: MM-CM-AB or AB-CM-MM. In some embodiments, the activatable antibody comprises a linking peptide between the MM and the CM. In some embodiments, the activatable antibody comprises a linking peptide between the CM and the AB. In some embodiments, the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM. In some embodiments, the two linking peptides need not be identical to each other. In some embodiments, the activatable antibody in the uncleaved state has the structural arrangement from N-terminus to C-terminus as follows: spacer-MM-LP1-CM-LP2-AB or AB-LP2-CM-LP1-MM-spacer.

In some embodiments, at least one of LP1 or LP2 comprises an amino acid sequence selected from the group consisting of $(GS)_n$, $(GGS)_n$, $(GSGGS)_n$ (SEQ ID NO: 339) and $(GGGS)_n$ (SEQ ID NO: 340), where n is an integer of at least one.

In some embodiments, at least one of LP1 or LP2 comprises an amino acid sequence selected from the group consisting of GGSG (SEQ ID NO: 341), GGSGG (SEQ ID NO: 342), GSGSG (SEQ ID NO: 343), GSGGG (SEQ ID NO: 344), GGGSG (SEQ ID NO: 345), and GSSSG (SEQ ID NO: 346).

In some embodiments, LP1 comprises the amino acid sequence GSSGGSGGSGGSG (SEQ ID NO: 347), GSSGGSGGSGG (SEQ ID NO: 348), GSSGGSGGSGGS (SEQ ID NO: 349), GSSGGSGGSGGSGGS (SEQ ID NO: 350), GSSGGSGGSG (SEQ ID NO: 351), or GSSGGSGGSGS (SEQ ID NO: 352).

In some embodiments, LP2 comprises the amino acid sequence GSS, GGS, GGGS (SEQ ID NO: 353), GSSGT (SEQ ID NO: 354) or GSSG (SEQ ID NO: 355).

The invention provides methods of preventing, delaying the progression of, treating, alleviating a symptom of, or otherwise ameliorating an CD71 mediated disease in a subject by administering a therapeutically effective amount of an anti-CD71 antibody, conjugated anti-CD71 antibody, activatable anti-CD71 antibody and/or conjugated activatable anti-CD71 antibody described herein to a subject in need thereof.

The invention also provides methods of preventing, delaying the progression of, treating, alleviating a symptom of, or otherwise ameliorating cancer in a subject by administering a therapeutically effective amount of an anti-CD71 antibody, conjugated anti-CD71 antibody, activatable anti-CD71 antibody and/or conjugated activatable anti-CD71 antibody described herein to a subject in need thereof. CD71 is known to be expressed in a variety of cancers, such as, by way of non-limiting example, adenocarcinoma, bile duct (biliary) cancer, bladder cancer, breast cancer, e.g., triple-negative breast cancer and Her2-negative breast cancer; carcinoid cancer; cervical cancer; cholangiocarcinoma; colorectal; endometrial; glioma; head and neck cancer, e.g., head and neck squamous cell cancer; leukemia; liver cancer; lung cancer, e.g., NSCLC, SCLC; lymphoma; melanoma; osopharyngeal cancer; ovarian cancer; pancreatic cancer; prostate cancer, e.g., metastatic castration-resistant prostate carcinoma; renal cancer; skin cancer; squamous cell cancer, stomach cancer; testis cancer; thyroid cancer; and urothelial cancer.

In some embodiments, the cancer is associated with a CD71-expressing tumor. In some embodiments, the cancer is due to a CD71-expressing tumor.

An anti-CD71 antibody, a conjugated anti-CD71 antibody, an activatable anti-CD71 antibody and/or a conjugated activatable anti-CD71 antibody used in any of the embodiments of these methods and uses can be administered at any stage of the disease. For example, such an anti-CD71 antibody, conjugated anti-CD71 antibody, activatable anti-CD71 antibody and/or conjugated activatable anti-CD71 antibody can be administered to a patient suffering cancer of any stage, from early to metastatic. The terms subject and patient are used interchangeably herein.

In some embodiments, the subject is a mammal, such as a human, non-human primate, companion animal (e.g., cat, dog, horse), farm animal, work animal, or zoo animal. In some embodiments, the subject is a human. In some embodiments, the subject is a companion animal. In some embodiments, the subject is an animal in the care of a veterinarian.

The anti-CD71 antibody, conjugated anti-CD71 antibody, activatable anti-CD71 antibody and/or conjugated activatable anti-CD71 antibody and therapeutic formulations thereof are administered to a subject suffering from or susceptible to a disease or disorder associated with aberrant CD71 expression and/or activity. A subject suffering from or susceptible to a disease or disorder associated with aberrant CD71 expression and/or activity is identified using any of a variety of methods known in the art. For example, subjects suffering from cancer or other neoplastic condition are identified using any of a variety of clinical and/or laboratory tests such as, physical examination and blood, urine and/or stool analysis to evaluate health status. For example, subjects suffering from inflammation and/or an inflammatory disorder are identified using any of a variety of clinical and/or laboratory tests such as physical examination and/or bodily fluid analysis, e.g., blood, urine and/or stool analysis, to evaluate health status.

Administration of an anti-CD71 antibody, conjugated anti-CD71 antibody, activatable anti-CD71 antibody and/or conjugated activatable anti-CD71 antibody to a patient suffering from a disease or disorder associated with aberrant CD71 expression and/or activity is considered successful if any of a variety of laboratory or clinical objectives is achieved. For example, administration of an anti-CD71 antibody, conjugated anti-CD71 antibody, activatable anti-CD71 antibody and/or conjugated activatable anti-CD71 antibody to a patient suffering from a disease or disorder associated with aberrant CD71 expression and/or activity is considered successful if one or more of the symptoms associated with the disease or disorder is alleviated, reduced, inhibited or does not progress to a further, i.e., worse, state. Administration of an anti-CD71 antibody, conjugated anti-CD71 antibody, activatable anti-CD71 antibody and/or conjugated activatable anti-CD71 antibody to a patient suffering from a disease or disorder associated with aberrant CD71 expression and/or activity is considered successful if the disease or disorder enters remission or does not progress to a further, i.e., worse, state.

In some embodiments, the anti-CD71 antibody, conjugated anti-CD71 antibody, activatable anti-CD71 antibody and/or conjugated activatable anti-CD71 antibody and therapeutic formulations thereof are administered to a subject suffering from or susceptible to a disease or disorder, such as subjects suffering from cancer or other neoplastic condition, wherein the subject's diseased cells are expressing CD71. In some embodiments, the diseased cells are associated with aberrant CD71 expression and/or activity. In some embodiments, the diseased cells are associated with normal CD71 expression and/or activity. A subject suffering from or susceptible to a disease or disorder wherein the subject's diseased cells express CD71 is identified using any of a variety of methods known in the art. For example, subjects suffering from cancer or other neoplastic condition are identified using any of a variety of clinical and/or laboratory tests such as, physical examination and blood, urine and/or stool analysis to evaluate health status. For example, subjects suffering from inflammation and/or an inflammatory disorder are identified using any of a variety of clinical and/or laboratory tests such as physical examination and/or bodily fluid analysis, e.g., blood, urine and/or stool analysis, to evaluate health status.

In some embodiments, the anti-CD71 antibody, conjugated anti-CD71 antibody, activatable anti-CD71 antibody and/or conjugated activatable anti-CD71 antibody and therapeutic formulations thereof are administered to a subject suffering from or susceptible to a disease or disorder associated with cells expressing CD71 or the presence, growth, proliferation, metastasis, and/or activity of such cells, such as subjects suffering from cancer or other neoplastic conditions. In some embodiments, the cells are associated with aberrant CD71 expression and/or activity. In some embodiments, the cells are associated with normal CD71 expression and/or activity. A subject suffering from or susceptible to a disease or disorder associated with cells that express CD71 is identified using any of a variety of methods known in the art. For example, subjects suffering from cancer or other neoplastic condition are identified using any of a variety of clinical and/or laboratory tests such as, physical examination and blood, urine and/or stool analysis to evaluate health status. For example, subjects suffering from inflammation and/or an inflammatory disorder are identified using any of a variety of clinical and/or laboratory tests such as physical examination and/or bodily fluid analysis, e.g., blood, urine and/or stool analysis, to evaluate health status.

Administration of an anti-CD71 antibody, conjugated anti-CD71 antibody, activatable anti-CD71 antibody and/or conjugated activatable anti-CD71 antibody to a patient suffering from a disease or disorder associated with cells expressing CD71 is considered successful if any of a variety of laboratory or clinical objectives is achieved. For example, administration of an anti-CD71 antibody, conjugated anti-CD71 antibody, activatable anti-CD71 antibody and/or conjugated activatable anti-CD71 antibody to a patient suffering from a disease or disorder associated with cells expressing CD71 is considered successful if one or more of the symptoms associated with the disease or disorder is alleviated, reduced, inhibited or does not progress to a further, i.e., worse, state. Administration of an anti-CD71 antibody, conjugated anti-CD71 antibody, activatable anti-CD71 antibody and/or conjugated activatable anti-CD71 antibody to a patient suffering from a disease or disorder associated with cells expressing CD71 is considered successful if the disease or disorder enters remission or does not progress to a further, i.e., worse, state.

In some embodiments, the anti-CD71 antibody, conjugated anti-CD71 antibody, activatable anti-CD71 antibody and/or conjugated activatable anti-CD71 antibody is administered during and/or after treatment in combination with one or more additional agents such as, for example, a chemotherapeutic agent, an anti-inflammatory agent, and/or an immunosuppressive agent. In some embodiments, the anti-CD71 antibody, conjugated anti-CD71 antibody, activatable anti-CD71 antibody and/or conjugated activatable anti-CD71 antibody and the additional agent(s) are administered simultaneously. For example, the anti-CD71 antibody, conjugated anti-CD71 antibody, activatable anti-CD71 antibody and/or conjugated activatable anti-CD71 antibody and the additional agent(s) can be formulated in a single composition or administered as two or more separate compositions. In some embodiments, the anti-CD71 antibody, conjugated anti-CD71 antibody, activatable anti-CD71 antibody and/or conjugated activatable anti-CD71 antibody and the additional agent(s) are administered sequentially.

The disclosure also provides methods of treating, alleviating a symptom of, or delaying the progression of a disorder or disease in which diseased cells express CD71 comprising administering a therapeutically effective amount of an antibody of the disclosure or a conjugated antibody of the disclosure or a pharmaceutical composition comprising an antibody of the disclosure or a pharmaceutical composition comprising a conjugated antibody of the disclosure to a subject in need thereof. In some embodiments, the disorder or disease is cancer.

The disclosure also provides methods of treating, alleviating a symptom of, or delaying the progression of a disorder or disease associated with cells expressing CD71 comprising administering a therapeutically effective amount of an antibody of the disclosure or a conjugated antibody of the disclosure or a pharmaceutical composition comprising an antibody of the disclosure or a pharmaceutical composition comprising a conjugated antibody of the disclosure to a subject in need thereof. In some embodiments, the disorder or disease associated with cells expressing CD71 is cancer. In some embodiments, the cancer is an adenocarcinoma, a bile duct (biliary) cancer, a bladder cancer, a bone cancer, a breast cancer, a triple-negative breast cancer, a Her2-negative breast cancer, a carcinoid cancer, a cervical cancer, a cholangiocarcinoma, a colorectal cancer, a colon cancer, an endometrial cancer, a glioma, a head and neck cancer, a head and neck squamous cell cancer, a leukemia, a liver cancer, a lung cancer, a non-small cell lung cancer, a small cell lung cancer, a lymphoma, a melanoma, an oropharyngeal cancer, an ovarian cancer, a pancreatic cancer, a prostate cancer, a metastatic castration-resistant prostate carcinoma, a renal cancer, a sarcoma, a skin cancer, a squamous cell cancer, a stomach cancer, a testis cancer, a thyroid cancer, a urogenital cancer, or a urothelial cancer. In some embodiments, the natural ligand is transferrin. In some embodiments, the expression and/or activity of the mammalian CD71 is aberrant. In some embodiments, the method comprises administering an additional agent. In some embodiments, the additional agent is a therapeutic agent.

The disclosure also provides methods of inhibiting or reducing the growth, proliferation, or metastasis of cells expressing mammalian CD71 comprising administering a therapeutically effective amount of an antibody of the disclosure or a conjugated antibody of the disclosure or a pharmaceutical composition comprising an antibody of the disclosure or a pharmaceutical composition comprising a conjugated antibody of the disclosure to a subject in need thereof. In some embodiments, the natural ligand is transferrin. In some embodiments, the expression and/or activity of the mammalian CD71 is aberrant. In some embodiments, the method comprises administering an additional agent. In some embodiments, the additional agent is a therapeutic agent.

The disclosure also provides methods of inhibiting, blocking, or preventing the binding of a natural ligand to mammalian CD71, comprising administering a therapeutically effective amount of an antibody of the disclosure or a conjugated antibody of the disclosure or a pharmaceutical composition comprising an antibody of the disclosure or a pharmaceutical composition comprising a conjugated antibody of the disclosure to a subject in need thereof. In some embodiments, the natural ligand is transferrin. In some embodiments, the expression and/or activity of the mammalian CD71 is aberrant. In some embodiments, the method comprises administering an additional agent. In some embodiments, the additional agent is a therapeutic agent.

The disclosure also provides methods of treating, alleviating a symptom of, or delaying the progression of a disorder or disease in which diseased cells express CD71 comprising administering a therapeutically effective amount of an activatable antibody of the disclosure or a conjugated activatable antibody of the disclosure or a pharmaceutical composition comprising an activatable antibody of the disclosure or a pharmaceutical composition comprising a conjugated activatable antibody of the disclosure to a subject in need thereof. In some embodiments, the disorder or disease is cancer.

The disclosure also provides methods of treating, alleviating a symptom of, or delaying the progression of a disorder or disease associated with cells expressing CD71 comprising administering a therapeutically effective amount of an activatable antibody of the disclosure or a conjugated activatable antibody of the disclosure or a pharmaceutical composition comprising an activatable antibody of the disclosure or a pharmaceutical composition comprising a conjugated activatable antibody of the disclosure to a subject in need thereof. In some embodiments, the disorder or disease associated with cells expressing CD71 is cancer. In some embodiments, the cancer is an adenocarcinoma, a bile duct (biliary) cancer, a bladder cancer, a bone cancer, a breast cancer, a triple-negative breast cancer, a Her2-negative breast cancer, a carcinoid cancer, a cervical cancer, a cholangiocarcinoma, a colorectal cancer, a colon cancer, an endometrial cancer, a glioma, a head and neck cancer, a head and neck squamous cell cancer, a leukemia, a liver cancer, a lung cancer, a non-small cell lung cancer, a small cell lung cancer, a lymphoma, a melanoma, an oropharyngeal cancer, an ovarian cancer, a pancreatic cancer, a prostate cancer, a metastatic castration-resistant prostate carcinoma, a renal cancer, a sarcoma, a skin cancer, a squamous cell cancer, a stomach cancer, a testis cancer, a thyroid cancer, a urogenital cancer, or a urothelial cancer. In some embodiments, the natural ligand is transferrin. In some embodiments, the expression and/or activity of the mammalian CD71 is aberrant. In some embodiments, the method comprises administering an additional agent. In some embodiments, the additional agent is a therapeutic agent.

The disclosure also provides methods of inhibiting or reducing the growth, proliferation, or metastasis of cells expressing mammalian CD71 comprising administering a therapeutically effective amount of an activatable antibody of the disclosure or a conjugated activatable antibody of the disclosure or a pharmaceutical composition comprising an activatable antibody of the disclosure or a pharmaceutical composition comprising a conjugated activatable antibody of the disclosure to a subject in need thereof. In some embodiments, the natural ligand is transferrin. In some embodiments, the expression and/or activity of the mammalian CD71 is aberrant. In some embodiments, the method comprises administering an additional agent. In some embodiments, the additional agent is a therapeutic agent.

The disclosure also provides methods of inhibiting, blocking, or preventing the binding of a natural ligand to mammalian CD71, comprising administering a therapeutically effective amount of an activatable antibody of the disclosure or a conjugated activatable antibody of the disclosure or a pharmaceutical composition comprising an activatable antibody of the disclosure or a pharmaceutical composition comprising a conjugated activatable antibody of the disclosure to a subject in need thereof. In some embodiments, the natural ligand is transferrin. In some embodiments, the expression and/or activity of the mammalian CD71 is aberrant. In some embodiments, the method comprises administering an additional agent. In some embodiments, the additional agent is a therapeutic agent.

The invention also provides methods and kits for using the activatable anti-CD71 antibodies and/or conjugated activatable anti-CD71 antibodies in a variety of diagnostic and/or prophylactic indications. For example, the invention provides methods and kits for detecting the presence or absence of a cleaving agent and a target of interest in a subject or a sample by (i) contacting a subject or sample with an anti-CD71 activatable antibody, wherein the anti-CD71 activatable antibody comprises a masking moiety (MM), a cleavable moiety (CM) that is cleaved by the cleaving agent, and an antigen binding domain or fragment thereof (AB) that specifically binds the target of interest, wherein the anti-CD71 activatable antibody in an uncleaved, non-activated state comprises a structural arrangement from N-terminus to C-terminus as follows: MM-CM-AB or AB-CM-MM; (a) wherein the MM is a peptide that inhibits binding of the AB to CD71, and wherein the MM does not have an amino acid sequence of a naturally occurring binding partner of the AB and is not a modified form of a natural binding partner of the AB; and (b) wherein, when the AB is in an uncleaved, non-activated state, the MM interferes with specific binding of the AB to CD71, and when the AB is in a cleaved, activated state the MM does not interfere or compete with specific binding of the AB to CD71; and (ii) measuring a level of activated anti-CD71 activatable antibody in the subject or sample, wherein a detectable level of activated anti-CD71 activatable antibody in the subject or sample indicates that the cleaving agent and CD71 are present in the subject or sample and wherein no detectable level of activated anti-CD71 activatable antibody in the subject or sample indicates that the cleaving agent, CD71 or both the cleaving agent and CD71 are absent in the subject or sample.

In some embodiments, the activatable anti-CD71 antibody is an activatable anti-CD71 antibody to which a therapeutic agent is conjugated. In some embodiments, the activatable anti-CD71 antibody is not conjugated to an agent. In some embodiments, the activatable anti-CD71 antibody comprises a detectable label. In some embodiments, the detectable label is positioned on the AB. In some embodiments, measuring the level of activatable anti-CD71 antibody in the subject or sample is accomplished using a secondary reagent that specifically binds to the activated antibody, wherein the reagent comprises a detectable label. In some embodiments, the secondary reagent is an antibody comprising a detectable label.

In some embodiments of these methods and kits, the activatable anti-CD71 antibody includes a detectable label. In some embodiments of these methods and kits, the detectable label includes an imaging agent, a contrasting agent, an enzyme, a fluorescent label, a chromophore, a dye, one or more metal ions, or a ligand-based label. In some embodiments of these methods and kits, the imaging agent comprises a radioisotope. In some embodiments of these methods and kits, the radioisotope is indium or technetium. In some embodiments of these methods and kits, the contrasting agent comprises iodine, gadolinium or iron oxide. In some embodiments of these methods and kits, the enzyme comprises horseradish peroxidase, alkaline phosphatase, or β-galactosidase. In some embodiments of these methods and kits, the fluorescent label comprises yellow fluorescent protein (YFP), cyan fluorescent protein (CFP), green fluorescent protein (GFP), modified red fluorescent protein (mRFP), red fluorescent protein tdimer2 (RFP tdimer2), HCRED, or a europium derivative. In some embodiments of these methods and kits, the luminescent label comprises an N-methylacrydium derivative. In some embodiments of these methods, the label comprises an Alexa Fluor® label, such as Alex Fluor® 680 or Alexa Fluor® 750. In some embodiments of these methods and kits, the ligand-based label comprises biotin, avidin, streptavidin or one or more haptens.

In some embodiments of these methods and kits, the subject is a mammal. In some embodiments of these methods, the subject is a human. In some embodiments, the subject is a non-human mammal, such as a non-human primate, companion animal (e.g., cat, dog, horse), farm animal, work animal, or zoo animal. In some embodiments, the subject is a rodent.

In some embodiments of these methods and kits, the method is an in vivo method. In some embodiments of these methods, the method is an in situ method. In some embodiments of these methods, the method is an ex vivo method. In some embodiments of these methods, the method is an in vitro method.

In some embodiments of the methods and kits, the method is used to identify or otherwise refine a patient population suitable for treatment with an anti-CD71 activatable antibody of the disclosure, followed by treatment by administering that activatable anti-CD71 antibody and/or conjugated activatable anti-CD71 antibody to a subject in need thereof. For example, patients that test positive for both the target (e.g., CD71) and a protease that cleaves the substrate in the cleavable moiety (CM) of the anti-CD71 activatable antibody being tested in these methods are identified as suitable candidates for treatment with such an anti-CD71 activatable antibody comprising such a CM, and the patient is then administered a therapeutically effective amount of the activatable anti-CD71 antibody and/or conjugated activatable anti-CD71 antibody that was tested. Likewise, patients that test negative for either or both of the target (e.g., CD71) and the protease that cleaves the substrate in the CM in the activatable antibody being tested using these methods might be identified as suitable candidates for another form of therapy. In some embodiments, such patients can be tested with other anti-CD71 activatable antibodies until a suitable anti-CD71 activatable antibody for treatment is identified (e.g., an anti-CD71 activatable antibody comprising a CM that is cleaved by the patient at the site of disease). In some embodiments, the patient is then administered a therapeutically effective amount of the activatable anti-CD71 antibody and/or conjugated for which the patient tested positive. Suitable AB, MM, and/or CM include any of the AB, MM, and/or CM disclosed herein.

Pharmaceutical compositions according to the invention can include an antibody of the invention and a carrier. These pharmaceutical compositions can be included in kits, such as, for example, diagnostic kits.

In some embodiments, the pharmaceutical composition comprises an antibody of the disclosure, an activatable antibody of the disclosure, a conjugated antibody or the disclosure, and/or a conjugated activatable antibody of the disclosure, and a carrier. In some embodiments, the pharmaceutical composition comprises an additional agent. In some embodiments, the additional agent is a therapeutic agent.

BRIEF DESCRIPTION OF THE DRAWINGS

FIG. 6C is a graph depicting that the murine and humanized anti-CD71 antibodies of the disclosure bind to the human BxPC3 cell line.

FIGS. 14A to 14G depict exemplary tolerability studies of anti-CD71 conjugated activatable antibodies (AADCs) of the present disclosure in cynomolgus monkeys.

FIGS. 16A to 16D depict exemplary studies of the ability of various anti-CD71 activatable antibodies of the present disclosure to bind human CD71 on various human-derived cell lines.

FIGS. 22A and 22B depicts exemplary studies of the cytotoxicity of various anti-CD71 antibody drug conjugates and activatable drug conjugates of the present disclosure on a HT29 colorectal cancer-derived cell line.

FIGS. 24A and 24B depict exemplary efficacy studies of activatable anti-CD71 conjugated antibodies (AADCs) of the present disclosure using non-small cell lung cancer (NCI-H292) tumor xenografts in mice.

FIGS. 26A and 26B depict exemplary efficacy studies of activatable anti-CD71 conjugated antibodies (AADCs) of the present disclosure using patient-derived tumor xenografts (non-Hodgkin's lymphoma) in mice.

FIGS. 27A and 27B depict exemplary efficacy studies of activatable anti-CD71 conjugated antibodies (AADCs) of the present disclosure using patient-derived tumor xenografts in mice.

DETAILED DESCRIPTION OF THE INVENTION

Figure 1:
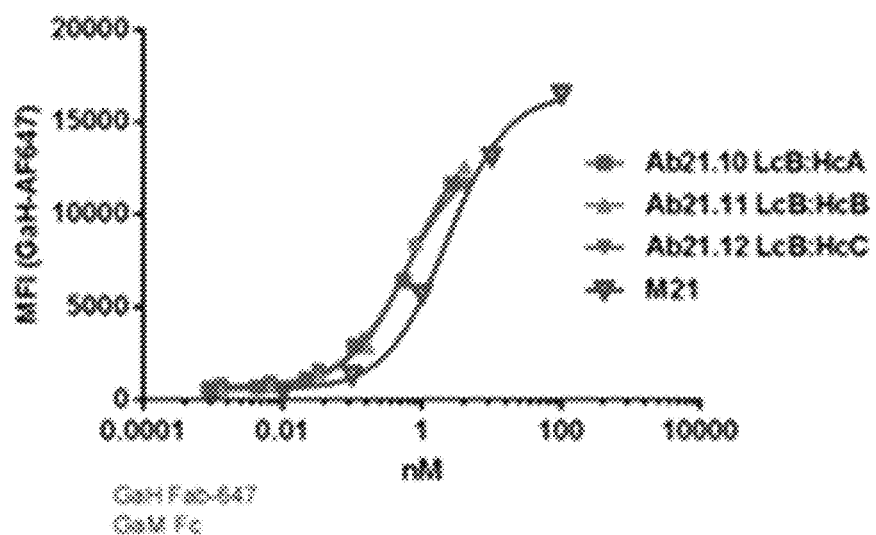
FIG. 1 is a graph depicting the ability of anti-CD71 antibodies of the disclosure to bind human CD71.

The present disclosure provides monoclonal antibodies (mAbs) and activatable monoclonal antibodies that specifically bind CD71, also known as transferrin receptor protein 1 (TfR1). In some embodiments, the monoclonal antibodies and activatable monoclonal antibodies are internalized by CD71-containing cells. The use of the term "CD71" is intended to cover any variation thereof, such as, by way of non-limiting example, CD-71 and/or CD 71, and all variations are used herein interchangeably.

CD71 is a transmembrane glycoprotein that primarily binds transferrin. CD71 is essential for cell homeostasis. CD71 is continuously recycled through ligand-mediated endocytosis, where the main ligand is transferrin. CD71 is also known to be ubiquitously expressed on dividing cells.

Aberrant expression and/or activity of CD71 and CD71-related signaling have been implicated in the pathogenesis of many diseases and disorders, such as cancer. CD71 is overexpressed in many cancers, including both solid and hematological cancers. CD71 has broad cell surface expression. CD71 in malignant cells mediates higher iron uptake required for cell division. CD71 is also associated with poor prognosis in leukemias.

CD71 is desirable target because it is prevalent across multiple cancer indications.

The disclosure provides anti-CD71 antibodies, conjugated anti-CD71 antibodies, activatable anti-CD71 antibodies, and/or conjugated activatable anti-CD71 antibodies that are useful in methods of treating, preventing, delaying the progression of, ameliorating and/or alleviating a symptom of a disease or disorder associated with aberrant CD71 expression and/or activity. For example, the activatable anti-CD71 antibodies are used in methods of treating, preventing, delaying the progression of, ameliorating and/or alleviating a symptom of a cancer or other neoplastic condition.

The disclosure provides anti-CD71 antibodies, conjugated anti-CD71 antibodies, activatable anti-CD71 antibodies, and/or conjugated activatable anti-CD71 antibodies that are useful in methods of treating, preventing, delaying the progression of, ameliorating and/or alleviating a symptom of a disease or disorder associated with cells expressing CD71. In some embodiments, the cells are associated with aberrant CD71 expression and/or activity. In some embodiments, the cells are associated with normal CD71 expression and/or activity. For example, the activatable anti-CD71 antibodies are used in methods of treating, preventing, delaying the progression of, ameliorating and/or alleviating a symptom of a cancer or other neoplastic condition.

The disclosure provides anti-CD71 antibodies, conjugated anti-CD71 antibodies, activatable anti-CD71 antibodies, and/or conjugated activatable anti-CD71 antibodies that are useful in methods of treating, preventing, delaying the progression of, ameliorating and/or alleviating a symptom of a disease or disorder in which diseased cells express CD71. In some embodiments, the diseased cells are associated with aberrant CD71 expression and/or activity. In some embodiments, the diseased cells are associated with normal CD71 expression and/or activity. For example, the activatable anti-CD71 antibodies are used in methods of treating, preventing, delaying the progression of, ameliorating and/or alleviating a symptom of a cancer or other neoplastic condition.

The activatable anti-CD71 antibodies and/or conjugated activatable anti-CD71 antibodies include an antibody or antigen-binding fragment thereof that specifically binds CD71 coupled to a masking moiety (MM), such that coupling of the MM reduces the ability of the antibody or antigen-binding fragment thereof to bind CD71. In some embodiments, the MM is coupled via a sequence that includes a substrate for a protease, for example, a protease that is co-localized with CD71 at a treatment site in a subject.

Exemplary activatable anti-CD71 antibodies of the invention include, for example, activatable antibodies that include a heavy chain and a light chain that are, or are derived from, the heavy chain variable and light chain variable sequences shown below (CDR sequences are shown in bold and underline):

muM21 VH:

(SEQ ID NO: 1)
EVQLQESGTVLARPGASVKMSCKASGYTFTSYWMHWVKQRPGQGLEWIGAIYPGNSETGYNQNFKGKAKL
TAVTSASTAYMDLSSLTNEDSAVYYCTRENWDPGFAFWGQGTLITVSA

```
muM21 VL:
                                                          (SEQ ID NO: 2)
DIVMTQTPAIMSASPGEKVTITCSASSSVYYMYWFQQKPGTSPKLWIYSTSNLASGVPVRFSGSGSGTSY
SLTISRMEAEDAATYYCQQRRNYPYTFGGGTKLEIKRA hu2vHa variable heavy chain
                                                          (SEQ ID NO: 3)
QVQLVQSGAEVKKPGASVKVSCKASGYTFTSYWMHWVRQAPGQGLEWMGAIYPGNSETGYAQKFQGRVTM
TRDTSTSTVYMELSSLRSEDTAVYYCARENWDPGFAFWGQGTLVTVSS hu2vHb variable heavy chain
                                                          (SEQ ID NO: 4)
QVQLVQSGAEVKKPGASVKMSCKASGYTFTSYWMHWVRQAPGQGLEWIGAIYPGNSETGYAQKFQGRATL
TADTSTSTAYMELSSLRSEDTAVYYCTRENWDPGFAFWGQGTLVTVSS hu2vHc variable heavy chain
                                                          (SEQ ID NO: 5)
QVQLVQSGAEVKKPGASVKMSCKASGYTFTSYWMHWVRQAPGQGLEWIGAIYPGNSETGYAQKFQGRATL
TADTSTSTAYMELSSLRSEDTAVYYCTRENWDPGFAFWGQGTLITVSS hu21vKa variable light chain
                                                          (SEQ ID NO: 6)
DIQMTQSPSSLSASVGDRVTITCSASSSVYYMYWYQQKPGKAPKLLIYSTSNLASGVPSRFSGSGSGTDF
TLTISSLQPEDFATYYCQQRRNYPYTFGQGTKLEIK hu21vKb variable light chain
                                                          (SEQ ID NO: 7)
DIQMTQSPSSLSASVGDRVTITCSASSSVYYMYWFQQKPGKAPKLWIYSTSNLASGVPSRFSGSGSGTDY
TLTISSMQPEDFATYYCQQRRNYPYTFGQGTKLEIK hu21vKc variable light chain
                                                          (SEQ ID NO: 8)
DIQMTQSPSSLSASVGDRVTITCRASSSVYYMYWFQQKPGKAPKLWIYSTSNLASGVPSRFSGSGSGTDY
TLTISSMQPEDFATTYCQQRRNYPYTFGQGTKLEIK
```

Exemplary activatable anti-CD71 antibodies of the invention include, for example, activatable antibodies that include a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence comprising the amino acid sequence GYTFTSYWMH (SEQ ID NO: 9); a VH CDR2 sequence comprising the amino acid sequence AIYPGNSETG (SEQ ID NO: 10); a VH CDR3 sequence comprising the amino acid sequence ENWDPGFAF (SEQ ID NO: 11); a VL CDR1 sequence comprising the amino acid sequence SASSSVYYMY (SEQ ID NO: 12) or CRASSSVYYMY (SEQ ID NO: 13); a VL CDR2 sequence comprising the amino acid sequence STSNLAS (SEQ ID NO: 14); and a VL CDR3 sequence comprising the amino acid sequence QQRRNYPYT (SEQ ID NO: 15).

In some embodiments, the activatable anti-CD71 antibody includes a heavy chain that comprises or is derived from a heavy chain amino acid sequence shown in PCT Publication Nos. WO 2014/144060, WO 2014/189973, WO 2014/020140, in U.S. Pat. Nos. 8,663,598; 8,129,503; 7,736,647; 7,572,895; 4,434,156; in US Patent Application Publication Nos. US2014114054, US20140212423, US2013177579, US2013045206, US20130216476, US20120282176, and/or in Chinese Patent No. CN101245107B, the contents of each of which are hereby incorporated by reference in their entirety.

In some embodiments, the activatable anti-CD71 antibody includes a heavy chain that comprises or is derived from a heavy chain amino acid sequence shown in Table 12. In some embodiments, the activatable anti-CD71 antibody includes a light chain that comprises or is derived from a heavy chain amino acid sequence shown in Table 12. In some embodiments, the activatable anti-CD71 antibody includes a heavy chain that comprises or is derived from a heavy chain amino acid sequence shown in Table 12, and a light chain that comprises or is derived from a light chain amino acid sequence shown in Table 12. In some embodiments, the activatable anti-CD71 antibody includes a combination of heavy chain variable region and light chain variable region sequences from the combinations shown in Group A in Table 12. In some embodiments, the activatable anti-CD71 antibody includes a combination of heavy chain variable region and light chain variable region sequences from the sequences shown in Group B in Table 12. In some embodiments, the activatable anti-CD71 antibody includes a combination of heavy chain variable region and light chain variable region sequences from the sequences shown in Group C in Table 12. In some embodiments, the activatable anti-CD71 antibody includes a combination of heavy chain variable region and light chain variable region sequences from the sequences shown in Group D in Table 12. In some embodiments, the activatable anti-CD71 antibody includes the combination of heavy chain variable region and light chain variable region sequences shown in Group E in Table 12. In some embodiments, the activatable anti-CD71 antibody includes the combination of heavy chain variable region and light chain variable region sequences shown in Group F in Table 12. In some embodiments, the activatable anti-CD71 antibody includes a combination of heavy chain variable region and light chain variable region sequences from the sequences shown in Group G in Table 12. In some embodiments, the activatable anti-CD71 antibody includes a combination of heavy chain variable region and light chain variable region sequences from the sequences shown in Group H in Table 12. In some embodiments, the activatable anti-CD71 antibody includes the combination of heavy chain variable region and light chain variable region sequences shown in Group I in Table 12. In some embodiments, the activatable anti-CD71 antibody includes the heavy chain variable region sequence shown in Group J in Table 12. In some embodiments, the activatable anti-CD71 antibody includes the heavy chain variable region sequence shown in Group J in Table 12, or the combination of heavy chain variable region and light chain variable region sequences shown in Group K in Table 12. In some embodiments, the activatable anti-CD71 antibody includes a combination of heavy chain variable region and light chain variable region sequences from the sequences shown in Group L in Table 12.

In some embodiments, the activatable anti-CD71 antibody includes a combination of the complementarity determining region (CDR) sequences of a heavy chain sequence from the heavy chain sequences shown in Group A Table 12. In some embodiments, the activatable anti-CD71 antibody includes a combination of the CDRs of a light chain sequence from the light chain sequences shown in Group A Table 12. In some embodiments, the activatable anti-CD71 antibody includes a combination of the CDRs of a heavy chain sequence from the heavy chain sequences shown in Group A Table 12 and the CDRs of a light chain sequence from the heavy chain sequences shown in Group A Table 12.

In some embodiments, the activatable anti-CD71 antibody includes a combination of CDRs of a heavy chain sequence from the heavy chain sequences shown in Group B Table 12. In some embodiments, the activatable anti-CD71 antibody includes a combination of the CDRs of a light chain sequence from the light chain sequences shown in Group B Table 12. In some embodiments, the activatable anti-CD71 antibody includes a combination of the CDRs of a heavy chain sequence from the heavy chain sequences shown in Group B Table 12 and the CDRs of a light chain sequence from the heavy chain sequences shown in Group B Table 12.

In some embodiments, the activatable anti-CD71 antibody includes a combination of the CDRs of a heavy chain sequence from the heavy chain sequences shown in Group C Table 12. In some embodiments, the activatable anti-CD71 antibody includes a combination of the CDRs of a light chain sequence from the light chain sequences shown in Group C Table 12. In some embodiments, the activatable anti-CD71 antibody includes a combination of the CDRs of a heavy chain sequence from the heavy chain sequences shown in Group C Table 12 and the CDRs of a light chain sequence from the heavy chain sequences shown in Group C Table 12.

In some embodiments, the activatable anti-CD71 antibody includes a combination of the CDRs of a heavy chain sequence from the heavy chain sequences shown in Group D Table 12. In some embodiments, the activatable anti-CD71 antibody includes a combination of the CDRs of a light chain sequence from the light chain sequences shown in Group D Table 12. In some embodiments, the activatable anti-CD71 antibody includes a combination of the CDRs of a heavy chain sequence from the heavy chain sequences shown in Group D Table 12 and the CDRs of a light chain sequence from the heavy chain sequences shown in Group D Table 12.

In some embodiments, the activatable anti-CD71 antibody includes a combination of the CDRs of a heavy chain sequence from the heavy chain sequences shown in Group E Table 12. In some embodiments, the activatable anti-CD71 antibody includes a combination of the CDRs of a light chain sequence from the light chain sequences shown in Group E Table 12. In some embodiments, the activatable anti-CD71 antibody includes a combination of the CDRs of a heavy chain sequence from the heavy chain sequences shown in Group E Table 12 and the CDRs of a light chain sequence from the heavy chain sequences shown in Group E Table 12.

In some embodiments, the activatable anti-CD71 antibody includes a combination of the CDRs of a heavy chain sequence from the heavy chain sequences shown in Group F Table 12. In some embodiments, the activatable anti-CD71 antibody includes a combination of the CDRs of a light chain sequence from the light chain sequences shown in Group F Table 12. In some embodiments, the activatable anti-CD71 antibody includes a combination of the CDRs of a heavy chain sequence from the heavy chain sequences shown in Group F Table 12 and the CDRs of a light chain sequence from the heavy chain sequences shown in Group F Table 12.

In some embodiments, the activatable anti-CD71 antibody includes a combination of the CDRs of a heavy chain sequence from the heavy chain sequences shown in Group G Table 12. In some embodiments, the activatable anti-CD71 antibody includes a combination of the CDRs of a light chain sequence from the light chain sequences shown in Group G Table 12. In some embodiments, the activatable anti-CD71 antibody includes a combination of the CDRs of a heavy chain sequence from the heavy chain sequences shown in Group G Table 12 and the CDRs of a light chain sequence from the heavy chain sequences shown in Group G Table 12.

In some embodiments, the activatable anti-CD71 antibody includes a combination of the CDRs of a heavy chain sequence from the heavy chain sequences shown in Group H Table 12. In some embodiments, the activatable anti-CD71 antibody includes a combination of the CDRs of a light chain sequence from the light chain sequences shown in Group H Table 12. In some embodiments, the activatable anti-CD71 antibody includes a combination of the CDRs of a heavy chain sequence from the heavy chain sequences shown in Group H Table 12 and the CDRs of a light chain sequence from the heavy chain sequences shown in Group H Table 12.

In some embodiments, the activatable anti-CD71 antibody includes a combination of the CDRs of a heavy chain sequence from the heavy chain sequences shown in Group I Table 12. In some embodiments, the activatable anti-CD71 antibody includes a combination of the CDRs of a light chain sequence from the light chain sequences shown in Group I Table 12. In some embodiments, the activatable anti-CD71 antibody includes a combination of the CDRs of a heavy chain sequence from the heavy chain sequences shown in Group I Table 12 and the CDRs of a light chain sequence from the heavy chain sequences shown in Group I Table 12.

In some embodiments, the activatable anti-CD71 antibody includes a combination of the CDRs of a heavy chain sequence from the heavy chain sequences shown in Group J Table 12. In some embodiments, the activatable anti-CD71 antibody includes a combination of the CDRs of a light chain sequence from the light chain sequences shown in Group J Table 12. In some embodiments, the activatable anti-CD71 antibody includes a combination of the CDRs of a heavy chain sequence from the heavy chain sequences shown in Group J Table 12 and the CDRs of a light chain sequence from the heavy chain sequences shown in Group J Table 12.

In some embodiments, the activatable anti-CD71 antibody includes a combination of the CDRs of a heavy chain sequence from the heavy chain sequences shown in Group K Table 12. In some embodiments, the activatable anti-CD71 antibody includes a combination of the CDRs of a light chain sequence from the light chain sequences shown in Group K Table 12. In some embodiments, the activatable anti-CD71 antibody includes a combination of the CDRs of a heavy chain sequence from the heavy chain sequences shown in Group K Table 12 and the CDRs of a light chain sequence from the heavy chain sequences shown in Group K Table 12.

In some embodiments, the activatable anti-CD71 antibody includes a combination of the CDRs of a heavy chain sequence from the heavy chain sequences shown in Group L Table 12. In some embodiments, the activatable anti-CD71 antibody includes a combination of the CDRs of a light chain sequence from the light chain sequences shown in Group L Table 12. In some embodiments, the activatable anti-CD71 antibody includes a combination of the CDRs of a heavy chain sequence from the heavy chain sequences shown in Group L Table 12 and the CDRs of a light chain sequence from the heavy chain sequences shown in Group L Table 12.

TABLE 12

Variable Heavy Chain Region (VH) and Variable Light Chain Region (VL) Sequences for Activatable Antibodies that Bind CD71

Group A

| | |
|---|---|
| VH | VTLKATCGPGILQPSQTLGLACTFSGISLS<u>TSGMGL</u>SWLRKPSGKALEWL<u>ASIWNNDNYYNPSLKS</u>RLTISKE TSNNQVFLKLTSVDTADSTTYFC<u>AWRERTMVTTSMLWTT</u>GVKEPQSPS (SEQ ID NO: 425) |
| VL | DILMTQSPASLSASVGENVTITC<u>RASENIYSYLA</u>WYQQKQGKSPQLLLY<u>KEKTLAEG</u>VSSRFSGSGSGTQFS LRINSLQPEDFGSYYC<u>QHHYGIPWT</u>FGGGTKLEIKR (SEQ ID NO: 426) |

Group B

| | |
|---|---|
| VH | EVQLVQSGAEVKKPGASVKVSCKASGYTFTSYWMHWVRQAPGQRLEWIG<u>EINPTNGRTNYIEKFKS</u>RATLTV DKSASTAYMELSSLRSEDTAVYYCARG<u>TRAYHY</u>WGQGTMVTVSS (SEQ ID NO: 427) |
| VH | EVQLVQSGAEVKKPGASVKVSCKGSGYTFTDYAMHWVRQAPGQGLEWMGG<u>ISTYFGRTNYNQKFKG</u>RVTMTV DTSISTAYMELSRLRSDDTAVYYCAR<u>GLSGNYVMDY</u>WGQGTTVTVSS (SEQ ID NO: 428) |
| VH | EVQLVQSGAEVKKPGASVKVSCKASGYTFTSYWMHWVRQAPGQGLEWIG<u>NIYPGSGSTKYDERFKS</u>RVTITV DTSTSTAYLELSSLRSEDTAVYYCTRGGYDSRAWFAYWGQGTLVTVSS (SEQ ID NO: 429) |
| VH | EVQLVESGPGLVKPSETLSLTCTVSGNSITSEYAWNWIRQPPGKGLEWIG<u>YISYSGTTSYNPSLKS</u>RVTISR DTSKNQLSLKLSSVTAADTAVYYCARY<u>GNPATRYFDV</u>WGQGTLVTVSS (SEQ ID NO: 430) |
| VH | EVQLVQSGAEVKKPGASVKVSCKASGYTFTSYWMHWVRQAPGQRLEWIG<u>EIAPTNGRTNYIEKFKS</u>RATLTV DKSASTAYMELSSLRSEDTAVYYCARG<u>TRAYHY</u>WGQGTMVTVSS (SEQ ID NO: 431) |
| VH | EVQLVQSGAEVKKPGASVKVSCKASGYTFTSYWMHWVRQAPGQRLEWIG<u>EINPANGRTNYIEKFKS</u>RATLTV DKSASTAYMELSSLRSEDTAVYYCARG<u>TRAYHY</u>WGQGTMVTVSS (SEQ ID NO: 432) |
| VL | DIQMTQSPSSLSASVGDRVTITCRASDNLYSNLAWYQQKPGKSPKLLVY<u>DATNLAD</u>GVPSRFSGSGSGTDYT LTISSLQPEDFATYYC<u>QHFWGTPLT</u>FGQGTKVEIK (SEQ ID NO: 433) |
| VL | DIVMTQSPDSLAVSLGERATINCRASESVDSYGNSFMHWYQQKPGQPPKLLIY<u>RASNLES</u>GVPDRFSGSGSR TDFTLTISSLQAEDVAVYYC<u>QQSNEAPPT</u>FGQGTKLEIK (SEQ ID NO: 434) |
| VL | DIVMTQSPDSLAVSLGERATINC<u>RARQSVSTSSYSFMH</u>WYQQPAGQPPKLLIK<u>YASIQES</u>GVPDRFSGSGSG TDFTLTISSLQAEDVAVYYC<u>QHTWEIPFT</u>FGQGTKVEIK (SEQ ID NO: 435) |
| VL | DIQMTQSPSSLSASVGDRVTITCRASKSISKYLAWYQQKPGKTNKLLLYSGSTLQSGVPSRFSGSGSGTDYT LTISSLQPEDFATYYC<u>QQHNEYPWT</u>FGQGTKVEIK (SEQ ID NO: 436) |
| VL | DIQMTQSPSSLSASVGDRVTITCRASDNLYSNLAWYQQKPGKSPKLLVY<u>DATNLAD</u>GVPSRFSGSGSGTDYT LTISSLQPEDFATYYCQHFAGTPLTFGQGTKVEIK (SEQ ID NO: 437) |

Group C

| | |
|---|---|
| VH | EVQLVESGGGLVQPGGSLRLSCAAS<u>GFTFSNYGMH</u>WIRQAPGKGLEWIA<u>MIYYDSSKMNYADTVKG</u>RFTISR DNAKNSLYLQMNSLRAEDTAVYYCAV<u>PTSHYVVD</u>VWGQGTTVTVSS (SEQ ID NO: 438) |
| VH | QVQLVQSGAEVKKPGASVKVSCKAS<u>GFTFSNYGMH</u>WIRQAPGQGLEWIA<u>MIYYDSSKMNYADTVKG</u>RFTITR DNSTNTLYMELSSLRSEDTAVYYCAV<u>PTSHYVVD</u>VWGQGTTVTVSS (SEQ ID NO: 440) |
| VH | EVQLVESGGGLVQPGNSLTLSCVAS<u>GFTFSNYGMH</u>WIRQAPKKGLEWIA<u>MIYYDSSKMNYADTVKG</u>RFTISR DNSKNTLYLEMNSLRSEDTAMYYCAV<u>PTSHYVVD</u>VWGQGVSVTVSS (SEQ ID NO: 442) |
| VH | QVQLVQSGAEVKKPGSSVKVSCKAS<u>GYTFTNYDIH</u>WVRQAPGQGLEWMG<u>WIYPGDGSTKYNEKFKG</u>RVTITA DESTSTAYMELSSLRSEDTAVYYCAREWA<u>YWGQGTTV</u>TVSS (SEQ ID NO: 443) |
| VH | EVQLQQSGAVLVKPGASVKLSCPASGFNIKDTYIHWVIQRPEQGLEWIGRIDPANGDTKCDPKFQVKATITA DTSSNTAYLQLSSLTSEDTAVYFCVRDYLYPYYFDFWGQGTTLTVSS (SEQ ID NO: 988) |
| VH | QSMEESGGRLVTPGTPLTLTCTVSGFSLSSYAMSWVRQAPGKGLEWIGYIWSGGSTDYASWAKGFETISKTS TTVDLKITSPTTEDTATYFCARRYGTSYPDYGDANGFDPWGPGTLVTVSS (SEQ ID NO: 989) |
| VL | DIQMTQSPASLSASLEEIVTITCQASQDIGNWLAWYQQKPGKSPQLLIYGATSLADGVPSRFSGSRSGTQFS LKISRVQVEDIGIYYCLQAYNTPWTFGGGTKLELK (SEQ ID NO: 985) |
| VL | DIQMTQSPASLSASLEEIVTITCQASQDIGNWLAWYQQKPGKSPQLLIYGATSLADGVPSRFSGSRSGTQFS LKISRVQVEDIGIYYCLQAYNTPWTFGGGTKVEIK (SEQ ID NO: 986) |
| VL | KIVMTQSPKSMSMSVGERVTLNCRASESVDTYVSWYQQKPEQSPELLIYGASNRYTGVPDRFTGSGSATDFT LTISSVQAEDLADYYCGQTYNYPLTFGAGTKLELKR (SEQ ID NO: 987) |
| VL | AYDMTQTPASVEVAVGGTVTIKCQASQSISSYLSWYQQKPGQRPKLLIYRASTLASGVSSRFKGSGSGTQFT LTISGVECADAATYYCQQCYSSNVDNTFGGGTEVVVKR (SEQ ID NO: 990) |

TABLE 12-continued

Variable Heavy Chain Region (VH) and Variable Light Chain Region (VL) Sequences for Activatable Antibodies that Bind CD71

Group D

| | |
|---|---|
| VH | MEWSWIFLFLLSGTAGVLSEVELQQFGIEMVKPGASVKISCKASGYIFTDYHMDWVRQSHGKSLEWIGDIDP KYDRVTYNQKFKGKASLTADKSSSTAYMELRSLTSEDTAVYYCAKTGAYGDYLAYWGQGTLVTVSA (SEQ ID NO: 444) |
| VH | MGWSYIILFLVATATGVHSQVQLQQPGAELVKPGTSVKLSCKASGYNFTSYWINWVKLRPGQGLEWIGDIYP GSGSTNYNEKFKSKATLTVDTSSSTAYMQLSSLASEDSALYYCARSAYRYDWFAYWGQGTLVTVSA (SEQ ID NO: 445) |
| VH | MLLGLKWVFFVVFYQGVHCEVQLVESGGGLVQPKGSLKLSCAASGFTFNTYAMNWVRQAPGKGLEWVARIRS KSNNYATYYADSVKDRFTISRDDSQSMLYLQMNNLKTEDTAMYYCVAYGSRNYWGQGTTLTVSS (SEQ ID NO: 446) |
| VH | MGWSWIFLFLLSGTAGVHSEVQLQQSGPEVVKPGASMKMSCKTSGYKFTGYYMDWVKQSLGASFEWIGRVIP SNGDTRYNQKFEGKATLTVDRSSSTAYMELNSLTSEDSAVYYCARKPLSGNAADYWGQGTSVTVST (SEQ ID NO: 447) |
| HC | EVQLQQSGPEVVKPGASMKMSCKTSGYKFTGYYMDWVKQSLGASFEWIGRVIPSNGDTRYNQKFEGKATLTV DRSSSTAYMELNSLTSEDSAVYYCARKPLSGNAADYWGQGTSVTVSTASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSHEDPEVKFNWYVDGVEVHN AKTKPREEQYNSTYRVVSVLTVLHQDWLNGKEYKCKVSNKALPAPIEKTISKAKGQPREPQVYTLPPSRDEL TKNQVSLTCLVKGFYPSDIAVEWESNGQPENNYKTTPPVLDSDGSFFLYSKLTVDKSRWQQGNVFSCSVMHE ALHNHYTQKSLSLSPGK (SEQ ID NO: 448) |
| VL | MKLPVRLLVLMFWIPASSSDLVMTQTPLSLPVSLGDQASISCRSSQSLVHSDGNTYFYWYLQKPGQSPKLLI YKVSNRFSGVPDRESAGGSGTYFTLKISRVEAEDLGVYFCSQTTHFPPTFGGGTKLEIKR (SEQ ID NO: 449) |
| VL | MSVPTQVLGLLLLWLTDARCDIQMTQSPASLSVSVGETVTITCRASENIYSNLAWYQQKQGKSPQLLVYAAT NLADGVPSRFSGSGSGTQYSLKINSLQSEDFGSYYCQHFWGTPYTFGGGTKLEIKR (SEQ ID NO: 450) |
| VL | MESQTQVLMSLLFWVSGTCGDIVMTQSPSSLTVTAGEKVTMSCKSSQSLLNSGNQKNYLTWYQQKPGQPPKL LIYWASTRESGVPDRFTGSGSGTDFTLTISSVQAEDLAVYYCQNDYSYPYTFGGGTKLEIKR (SEQ ID NO: 451) |
| VL | MTMLSLAPLLSLLLLCVSDSRAETTVTQSPASLSVATGEKVTIRCITSTDIDDDMNWYQQKPGEPPKLLISD GNTLRPGVPSRFSSSGYGTDFVFTIENTLSEDITDYYCMQSDNMPFTFGSGTKLEIKR (SEQ ID NO: 452) |
| LC | ETTVTQSPASLSVATGEKVTIRCITSTDIDDDMNWYQQKPGEPPKLLISDGNTLRPGVPSRFSSSGYGTDFV FTIENTLSEDITDYYCMQSDNMPFTFGSGTKLEIKRTTLAPSVFIFPPSDEQLKSGTASVVCLLNNFYPREA KVQWNVDNALQSGNSQESVTEQDSKDSTYSLSSTLTLSKADYEKHKVYACEVTHQGLSSPVTKSENRGEC (SEQ ID NO: 453) |

Group E

| | |
|---|---|
| VH | MEWSWVMLELLSGTAGVRSEVQLQQSGPELVKPGASMKISCKASGYSFTGYTMNWVKQSHGENLEWIGRINP HNGGTDYNQKFKDKAPLTVDKSSNTAYMELLSLTSEDSAVYYCARGYYYYSLDYWGQGTSVTVSS (SEQ ID NO: 454) |
| VL | MDFQVQIFSFLLISASVILSRGQIVLTQSPAIMSASPGEKVTMTCSASSSIDYIHWYQQKSGTSPKRWIYDT SKLASGVPARFSGSGSGTSYSLTISSMEPEDAATYYCHQRNSYPWTFGGGTRLEIR (SEQ ID NO: 455) |

Group F

| | |
|---|---|
| VH | MAQVQLLESGGGLVQPGGSLRLSCAASGFIFNTEYMAWVKAPGKGLEWVSAIKEQSGSTYYADSVKGRFTI SRDNSKNTLYLQMNSLRAEDTAVYYCAAQMHHEAEVKFWGQGTLVTVSS (SEQ ID NO: 456) |
| VH | MAQVQLLESGGGLVQPGGSLRLSCAASGFKFSAEYMSWVRQAPGKGLEWVSTIKMNNGSTYYADSVKGRFTI SRDNSKHTLYLQMNSLRAEDTAVYYCARPMAWRGNVVRAENLRFWGQGTLVTVSS (SEQ ID NO: 457) |

Group G

| | |
|---|---|
| VH | MEFGLSWLFLVAILKGVQCEVQLQQSGTVLARPGASVKMSCKASGYSFTIYWIHWVKQRPGQGLEWIATIYP GNSDIIYNQKFKGKAKLTAVTSASTAYMELSSLTNEASAVYYCTRQGYDYYAMDYWGQGTSVTVSS (SEQ ID NO: 458) |
| VL | MDMRVPAQLLGLLLLWLPGARCDVQITQSPSYLAASPGETIIINCRASKSISKYLAWYQEKPGKTNKLLIYS GSTLQSGIPSRFSGSGSGTDFTLTISSLEPQDEAMYYC<u>QQHNEYPWT</u>FGGGTKLEIK (SEQ ID NO: 459) |
| VL | NIVMTQSPKSMSMSVGERVTLTCKASENVVTYVSWYQQKPEQSPKLLIYGASNRYTGVPDRFTGSGSATDFT LTISSVQAEDLADYHCGQGYSYPYTFGGGTKLEIKR (SEQ ID NO: 460) |
| VL | MDMRVPAQLLGLLLLWLPGARCDVQITQSPSYLAASPGETIIINCRASKSISKYLAWYQEKPGKTNKLLIYS GSTLQSGIPSRFSGSGSGTDFTLTISSLEPQDFAMYYC<u>QQHNEYPWT</u>FGGGTKIEIKR (SEQ ID NO: 461) |
| VL | MDMRVPAQLLGLLLLWLPGARCDVQITQSPSYLAASPGETIIINCRASKSISKYLAWYQEKTGKTNKLIIYS GSTLQSGIPSRFSGSGSGTDFTLTISSLEPQDFAMYYC<u>QQHNEYPWT</u>FGGGTKLQIK (SEQ ID NO: 462) |
| VL | NIVMTQSPKSMSMSVGERVTLTCKASENVVTYVSWYQQKPEQSPKLLIYGASNRYTGVPDRFTGSGSATDFT LTISSVQAEDLADYHCGQGYSYPYTFGGGTKLQIKR (SEQ ID NO: 463) |
| VL | MDMRVPAQLLGLLLLWLPGARCDVQITQSPSYLAASPGETIIINCRASKSISKYLAWYQEKPGKTNKLLIYS GSTLQSGIPSRFSGSGSGTDFTLTISSLEPQDFAMYYC<u>QQHNEYPWT</u>FGGGTKLQIKR (SEQ ID NO: 464) |

TABLE 12-continued

Variable Heavy Chain Region (VH) and Variable Light Chain Region (VL) Sequences for Activatable Antibodies that Bind CD71

Group H

VH QVQLQESGGGLVQPGGSLRLSCAASGFSFN<u>TYTMH</u>WVRQAPGKGLEWVA<u>DIAYDGSTKYYADSVKG</u>RFTISR
DNAKNSLYLQMNSLRAEDTAVYYCAR<u>DAVAGEGYFDL</u>WGRGTLVTVS (SEQ ID NO: 465)

VH QVQLQQSGGGVVQPGGSLRLSCAASEFTFS<u>ASGMH</u>WVRQAPGKGLEWMA<u>FIAYDGNQKFYADSVKG</u>RFTISR
DNSKNTLYLQMDSLRGEDTAVYYCAK<u>EMQREGYFDY</u>WGQGTLVTVS (SEQ ID NO: 466)

VH QVQLAESGGGLVKTGGSLRLSCAASGFTFS<u>DYYMS</u>WIRQAPGKGLEWVS<u>YISTSGSSIYYVDSVKG</u>RFTISR
DNAKNSLYLQMDSLRDDDTAVYYCAR<u>DLHGDYAFDS</u>WGQGTLVTVS (SEQ ID NO: 467)

VH QVQLQESGGGLVQPGGSLRLSCAASGFTFS<u>SYAMS</u>WVRQAPGKGLEWVS<u>AISGSGGSTYYADSVKG</u>RFTISR
DNSKNTLYLQMNSLRAEDTAVYYCAK<u>VSSSWSHFDY</u>WGQGTLVTVS (SEQ ID NO: 468)

VH QVQLVESGGGLVEPGGSLRLSCAASGFTFS<u>NYAIN</u>WVRQAPGKGLEWVA<u>NIHHDGNGKYYVDSVEG</u>RFTISR
DNAKNSLYLQMDSLRAEDTAIYYCAR<u>DGYGGYLDL</u>WGQGTLVTVS (SEQ ID NO: 469)

VH QVQLQESGGGVVQPGRSLRLSCAASRFTFS<u>SYAMH</u>WVRQAPGKGLEWVA<u>VISYDGSNKYYADSVKG</u>RFTISR
DNSKNTLYLQMNSLRAEDTAVYYCAR<u>DLSGYGDYPDY</u>WGQGTLVTVS (SEQ ID NO: 470)

VL SNFMLTQDPAVSVALGQTVRITC<u>QGDSLRSYYAS</u>WYQQKPGQAPVLVIY<u>GKNNRPS</u>GIPDPFSGSKSGNSAS
LDISGLQSEDEADYYC<u>ATWDDNLSGPI</u>FGGGTKVTVLG (SEQ ID NO: 471)

VL SQSALTQDPAVSVALGQTVRITC<u>QGDSLRSYYAS</u>WYQQLPGTAPKLLIY<u>RNNQRPS</u>GVPDPFSGSKSGTSAS
LAISGLRSEDEADYYC<u>AAWDDSLSAWV</u>FGGGTKLTVLGA (SEQ ID NO: 472)

VL SSELTQDPAVSVALGQTVRITC<u>QGDSLRSYYAS</u>WYQQKPGQAPVLVIY<u>GKNNRPS</u>GIPDRFSGSKSGNSASL
DISGLQSEDEADYYC<u>ATWDDNLSGPI</u>FGGGTKVTVLG (SEQ ID NO: 473)

VL SDVVMTQSPSTLSASVGDRVTITC<u>RASQYISNWLA</u>WYQQKPGKAPKLLIY<u>KASSLES</u>GVPSRFSGSGSGTEF
TLTISSLQPEDFATYYC<u>QESYNTPLFT</u>FGPGTKLEIKR (SEQ ID NO: 474)

VL SSELTQDPAVSVALGQTVRITC<u>QGDSLRSYYAS</u>WYQQKPGQAPVLVIY<u>GKNNRPS</u>GIPDRFSGSGSGNTASL
TITGAQAEDEADYYC<u>AAWDDSLSGPV</u>FGGGTKVTVLG (SEQ ID NO: 475)

VL SSELTQDPAVSVALGQTVRITC<u>QGDSLRSYYAS</u>WYQQKPGQAPVLVMY<u>GRNERPS</u>GVPDRFSGSKSGTSASL
AISGLQPEDEANYYC<u>AGWDDSLTGPV</u>FGGGTKLTVLG (SEQ ID NO: 476)

VH/ QVQLQESGGGLVQPGGSLRLSCAASGFSFN<u>TYTMH</u>WVRQAPGKGLEWVA<u>DIAYDGSTKYYADSVKG</u>RFTISR
VL DNAKNSLYLQMNSLRAEDTAVYYCAR<u>DAVAGEGYFDL</u>WGRGTLVTVSSGGGGSGGGGSGGGGSQSALTQDPA
VSVALGQTVRITC<u>QGDSLRSYYAS</u>WYQQLPGTAPKLLIY<u>RNNQRPS</u>GVPDRFSGSKSGTSASLAISGLRSED
EADYYC<u>AAWDDSLSAWV</u>FGGGTKLTVLGA (SEQ ID NO: 477)

VH/ QVQLQQSGGGVVQPGGSLRLSCAASEFTFS<u>ASGMH</u>WVRQAPGKGLEWMA<u>FIAYDGNQKFYADSVKG</u>RFTISR
VL DNSKNTLYLQMDSLRGEDTAVYYCAK<u>EMQREGYFDY</u>WGQGTLVTVSSGGGGSGGGGSGGGGSNFMLTQDPAV
SVALGQTVRITC<u>QGDSLRSYYAS</u>WYQQKPGQAPVLVIY<u>GKNNRPS</u>GIPDRFSGSKSGNSASLDISGLQSEDE
ADYYC<u>ATWDDNLSGPI</u>FGGGTKVTVLG (SEQ ID NO: 478)

VH/ QVQLAESGGGLVKPGGSLRLSCAASGFTFS<u>DYYMS</u>WIRQAPGKGLEWVS<u>YISTSGSSIYYVDSVKG</u>RFTISR
VL DNAKNSLYLQMDSLRDDDTAVYYCAR<u>DLHGDYAFDS</u>WGQGTLVTVSSGGGGSGGGGSGGGGSSELTQDPAVS
VALGQTVRITC<u>QGDSLRSYYAS</u>WYQQKPGQAPVLVIY<u>GKNNRPS</u>GIPDRFSGSKSGNSASLDISGLQSEDEA
DYYC<u>ATWDDNLSGPI</u>FGGGTKVTVLG (SEQ ID NO: 479)

VH/ QVQLQESGGGLVQPGGSLRLSCAASGFTFS<u>SYAMS</u>WVRQAPGKGLEWVS<u>AISGSGGSTYYADSVKG</u>RFTISR
VL DNSKNTLYLQMNSLRAEDTAVYYCAK<u>VSSSWSHFDY</u>WGQGTLVTVSSGGGGSGGGGSGGGGSDVVMTQSPST
LSASVGDRVTITC<u>RASQYISNWLA</u>WYQQKPGKAPKLLIY<u>KASSLES</u>GVPSRFSGSGSGTEFTLTISSLQPED
FATYYC<u>QESYNTPLFT</u>FGPGTKLEIKR (SEQ ID NO: 480)

VH/ QVQLVESGGGLVEPGGSLRLSCAASGFTFS<u>NYAIN</u>WVRQAPGKGLEWVA<u>NIHHDGNGKYYVDSVEG</u>RFTISR
VL DNAKNSLYLQMDSLRAEDTAIYYCAR<u>DGYGGYLDL</u>WGQGTLVTVSSGGGGSGGGGSGGGGSSELTQDPAVSV
ALGQTVRITC<u>QGDSLRSYYAS</u>WYQQKPGQAPVLVIY<u>GKNNRPS</u>GIPDRFSGSGSGNTASLTITGAQAEDEAD
YYC<u>AAWDDSLSGPV</u>FGGGTKVTVLG (SEQ ID NO: 481)

VH/ QVQLQESGGGVVQPGRSLRLSCAASRFTFS<u>SYAMH</u>WVRQAPGKGLEWVA<u>VISYDGSNKYYADSVKG</u>RFTISR
VL DNSKNTLYLQMNSLRAEDTAVYYCAR<u>DLSGYGDYPDY</u>WGQGTLVTVSSGGGGSGGGGSGGGGSSELTQDPAV
SVALGQTVRITC<u>QGDSLRSYYAS</u>WYQQKPGQAPVLVMY<u>GRNERPS</u>GVPDRFSGSKSGTSASLAISGLQPEDE
ANYYC<u>AGWDDSLTGPV</u>FGGGTKLTVLG (SEQ ID NO: 482)

Group I

VH MEFGLSWLFLVAILKGVQCEVQLQQSGTVLARPGASVKMSCKASGYSFTIYWIHWVKQRPGQGLEWIATIYP
GNSDIIYNQKFKGKKLTAVTSASTAYMELSSLTNEASAVYYCTRQGYDYYAMDYWGQGTSVTVSS (SEQ
ID NO: 463)

VL MDMRVPAQLLGLLLLWLPGARCDVQITQSPSYLAASPGETIINCRASKSISKYLAWYQEKPGKTNELLIYS
GSTLQSGIPSRFSGSGSGTDFTLTISSLEPQDFAMYYC<u>QQHNEYPWT</u>FGGGTKLEIKR (SEQ ID
NO: 484)

Group J

VH EVQLLESGGGLVQPGGSLRLSCAASGFTFAHETMVWVRQAPGKGLEWVSHIPPVGQDPFYADSVKGRFTISR
DNSKNTLYLQMNSLRAEDTAVYYCALLPKRGPWFDYWGQGTLVTVSS (SEQ ID NO: 485)

Group K

VH EVQLLESGGGLVQPGGSLRLSCAASGFTFAHETMVWVRQAPGKGLEWVSHIPPVGQDPFYADSVKGRFTISR
DNSKNTLYLQMNSLRAEDTAVYYCALLPKRGPWFDYWGQGTLVTVSS (SEQ ID NO: 465)

TABLE 12-continued

Variable Heavy Chain Region (VH) and Variable Light Chain Region (VL) Sequences for Activatable Antibodies that Bind CD71

| | |
|---|---|
| VH/VL | MASYELTQPPSVSVAPGQTARITCSGDALGNKYASWYQQKPGQAPVLVIYEDSKRPSGIPERFSGSNSGNTA TLTISGTQAEDEADYYCSSGDSPCRAFGGGTKLTVLGSGGSTITSYNVYYTKLSSSGSEVQLVESGGGLVQP GGSLRISCAASGFTFS<u>SYAMS</u>WVRQAPGKGLEWVS<u>AISGSGGSTYYADSVK</u>GRFTISRDNSKNTLYLQMNSL RAEDTAVYYCARHSIYRCFFAVWGQGTLVTVSS (SEQ ID NO: 487) |

Group L

| | |
|---|---|
| VH | DVQLVESGGGLVQPGGSLRLSCAASGFPFK<u>SYGMQ</u>WVRQAPGKGLEWVA<u>VISFDGSSRYYADSVK</u>GRFTISR DNSKNTLYLQMNSLRAEDTAVYYCAR<u>DGALWGGYYSPVD</u>VWGQGTLVTVS (SEQ ID NO: 999) |
| VH | DVQLVESGGGLVQPGGSLRLSCAASGFPFK<u>SYAMH</u>WVRQAPGKGLEWVA<u>VISYDGSNKYYADSVK</u>GRFTISR DNSKNTLYLQMNSLRAEDTAVYYCAR<u>DGALWGGYYSPVD</u>VWGQGTLVTVSS (SEQ ID NO: 1000) |
| VH | DVQLVESGGGLVQPGGSLRLSCAASGFPFK<u>SYAMH</u>WVRQAPGKGLEWVA<u>VISFDGSNKYYADSVK</u>GRFTISR DNSKNTLYLQMNSLRAEDTAVYYCAR<u>DGALWGGYYSPVD</u>VWGQGTLVTVSS (SEQ ID NO: 1001) |
| VH | DVQLVESGGGLVQPGGSLRLSCAASGFPFK<u>SYAMH</u>WVRQAPGKGLEWVA<u>VISFDGGSRYYADSVK</u>GRFTISR DNSKNTLYLQMNSLRAEDTAVYYCAR<u>DGALWGGYYSPVD</u>VWGQGTLVTVSS (SEQ ID NO: 1002) |
| VH | DVQLVESGGGLVQPGGSLRLSCAASGFPFK<u>SYGMQ</u>WVRQAPGKGLEWVA<u>VISFDGGSRYYADSVK</u>GRFTISR DNSKNTLYLQMNSLRAEDTAVYYCAR<u>DGALWGGYYSPVD</u>VWGQGTLVTVSS (SEQ ID NO: 1003) |
| VH | DVQLVESGGGLVQPGGSLRLSCAASGFTFS<u>SYAMQ</u>WVRQAPGKGLEWVA<u>VISFDGGSRYYADSVK</u>GRFTISR DNSKNTLYLQMNSLRAEDTAVYYCAR<u>DGALWGGYYSPVD</u>VWGQGTLVTVSS (SEQ ID NO: 1004) |
| VH | DVQLVESGGGLVQPGGSLRLSCAASGFTFS<u>SYGMQ</u>WVRQAPGKGLEWVA<u>VISFDGGSRYYADSVK</u>GRFTISR DNSKNTLYLQMNSLRAEDTAVYYCAR<u>DGALWGGYYSPVD</u>VWGQGTLVTVSS (SEQ ID NO: 1005) |
| VH | DVQLVESGGGLVQPGGSLRLSCAASGFTFS<u>SYAMQ</u>WVRQAPGKGLEWVS<u>VISFDGGNRYYADSVK</u>GRFTISR DNSKNTLYLQMNSLRAEDTAVYYCAR<u>DGALWGGYYSPVD</u>VWGQGTLVTVSS (SEQ ID NO: 1006) |
| VH | DVQLVESGGGLVQPGGSLRLSCAASGFTFS<u>SYAMQ</u>WVRQAPGKGLEWVSIVSFDGGNRYYADSIGRFTISRD NSKNTLYLQMNSLRAEDTAVYYCAR<u>DGALWGGYYSPID</u>VWGQGTLVTVSS (SEQ ID NO: 1007) |
| VL | DFMITQPHSVSESPGKTVTISCTRSSGSIASNYVQWYQQRPGSSPTTVIYEDNQRPSGVPDRFSGSIDSSSN SASLTISGLKTEDEADYYCQSYDSSNHWVFGGGTKLAVL (SEQ ID NO: 1008) |
| VL | DFMLTQPQSVSESPGKTVTISCTRSSGSIASNYVQWYQQRPGSSPTTVIYEDNQRPSGVPDRFSGSIDSSSN SASLTISGLKTEDEADYYCQSYDSSNQWVFGGGTKLAVL (SEQ ID NO: 1009) |
| VL | QSXLTQPPSVSGSPGQSVTISCTGSSSNIGSXNYVSWYQQXPGTAPKLMIYENNKRPSGVPDRFSGSKXXSG NTASLTISGLQAEDEADYYCSSWDSSLSX (SEQ ID NO: 1010) |
| VL | DSALTQPPSVSGSPGQSVTISCTGSSSNIIASNSVQWYQQLPGTAPKTVI<u>YEDTQRPS</u>GVPDRFSGSKDSSG NTASLTISGLQAEDEADYYC<u>QSYDSAYHWV</u>VGGGTKLAVL (SEQ ID NO: 1011) |
| VL | DSALTQPPSVSGSPGQSVTISCTGSSSNIIASNSVQWYQQLPGTAPKTVIYENTQRPSGVPDRFSGSKDSSG NTASLTISGLQAEDEADYYCSSYDSAYHWVFGGGTKLAVL (SEQ ID NO: 1012) |
| VL | DFMLTQPHSVSESPGKTVIISCTRSDGTIAGYYVQWYQQRPGRAPTTVIFEDTQRPSGVPDRFSGSIDRSSN SASLTISGLQTEDEADYYCQSYDRDHWVFGGGTKLTVLG (SEQ ID NO: 1013) |
| VL | DFMLTQPHSVSESPGKTVIISCTRSDGTIAGYYVQWYQQRPGRAPTTVIFEDTQRPSGVPDRFSGSIDRSSN SASLTISGLQTEDEADYYCQSYDSRDHWVFGGGTKLTVL (SEQ ID NO: 1014) |
| VL | DFMLTQPQSVSESPGKTVIISCTRSTGTIASNSVQWYQQRPGRAPTTVIFDETQRPSGVPDRFSGSIDRSSN SASLTISGLQTEDEADYYCQSYDSRDQWVFGGGTKLTVL (SEQ ID NO: 1015) |
| VL | DIQMTQSPSSLSASVGDRVTITCRASQSISNYLAWYQQKPGKAPKLLIYAASSLESGVPSRFSGSGSGTDFT LTISSLQPEDFATYYCQQYNSLPWTFGQGTKVEIK (SEQ ID NO: 1016) |
| VL | DIQMTQSPSSLSASVGDRVTITCRASQIASNSVQWYQQKPGKAPKTVIYEDTQLESGVPSRFSGSGSGTDFT LTISSLQPEDEATYYC<u>QSYDSAYHWV</u>FGQGTKVEIK (SEQ ID NO: 1017) |
| VL | DIQMTQSPSTLSASVGDRVTITCRASQISSWLAWYQQKPGKAPKILIYDASSLESGVPSRFSGSGSGTEFT LTISSLQPDDFATYYCQQYNSYS (SEQ ID NO: 1018) |
| VL | DIQMTQSPSTLSASVGDRVTITCRASQIASNSVQWYQQKPGKAPKTVIYEDTQLESGVPSRFSGSGSGTEFT LTISSLQPDDFATYYC<u>QSYDSAYHWV</u>FGQGTKVEIK (SEQ ID NO: 1019) |
| VL | DIQMTQSPSTLSASVGDRVTITCRASQIASNSVQWYQQKPGKAPKTVIYEDTQLESGVPSRFSGSGSGTEFT LTISSLQPDDFATYYCQSYNSAYHWVFGQGTKVEIK (SEQ ID NO: 1020) |
| VL | DIQMTQSPSTLSASVGDRVTITCRASQIASNSVQWYQQKPGKAPKTVIYEDTQLESGVPSRFSGSGSGTEFT LTISSLQPDDFATYYCQSYNSAYQWVFGQGTKVEIK (SEQ ID NO: 1021) |
| VL | DIQMTQSPSSLSASVGDRVTITCRASQGIRNDLTWYQQKPGTAPKRLIYGATSLQSGVPSRFSGSGSGTEFT LTINSLQPEDFATYYCLQYSSFPWTFGQGTKVEVK (SEQ ID NO: 1022) |
| VL | DIQMTQSPSSLSASVGDRVTITCRASQIASNSVQWYQQKPGTAPKTVIYEDTQLQSGVPSRFSGSGSGTEFT LTINSLQPEDFATYYC<u>QSYDSAYHWV</u>FGQGTKVEIK (SEQ ID NO: 1023) |
| VL | DIQMTQSPSSLSASVGDRVTITCRASQIASNSVQWYQQKPGTAPKTVIYEDTQLQSGVPSRFSGSGSGTEFT LTINSLQPEDFATYYCQSYNSAYHWVFGQGTKVEIK (SEQ ID NO: 1024) |
| VL | DIQMTQSPSSLSASVGDRVTITCRASQIASNSVQWYQQKPGTAPKTVIYEDTQLQSGVPSRFSGSGSGTEFT LTINSLQPEDFATYYCQSYNSAYQWVFGQGTKVEIK (SEQ ID NO: 1025) |

(VH/VL = VH linked to VL)

In some embodiments, the activatable anti-CD71 antibody includes a CDR sequence shown in Table 13, a combination of VL CDR sequences (VL CDR1, VL CDR2, VL CDR3) selected from the group consisting of those combinations shown in a single row Table 13, a combination of VH CDR sequences (VH CDR1, VH CDR2, VH CDR3) selected from the group consisting of those combinations shown in Table 13, or a combination of VL CDR and VH CDR sequences (VL CDR1, VL CDR2, VL CDR3, VH CDR1, VH CDR2, VH CDR3) selected the group consisting of those combinations shown in Table 13.

TABLE 13

CDR Sequences for Antibodies and Activatable Antibodies that Bind CD71

Group A

| VH | | | VL | | |
|---|---|---|---|---|---|
| CDR1 (SEQ ID NO) | CDR2 (SEQ ID NO) | CDR3 (SEQ ID NO) | CDR1 (SEQ ID NO) | CDR2 (SEQ ID NO) | CDR3 (SEQ ID NO) |
| TSGMGL (488) | ASIWNNDNYYNPSLKS (489) | AWRERTMVTTSMLWT (490) | RASENIYSYLA (491) | KEKTLAE (492) | QHHYGIPWT (493) |
| | GISTYFGRTNYNQKFKG (494) | GLSGNYVMDY (495) | RASESVDSYGNSFMH (496) | RASNLES (497) | QQSNEAPPT (500) |
| | VIS(F/P)YGKTNYSQNFMG (501) | GLSGNFVVDF (502) | RASESVDDYPNSFMH (503) | DATNLAD (504) | QHSNE(G/D)PPT (505) |
| | EINPTNGRTNYIEKFKS (506) | YGYGNPATRYFDV (507) | RASENLYSNLA (508) | DATDLAD (509) | QHFWGTPLT (510) |
| | EINP(I/S)NGRTNY(N/S)E(N/T)FKK (511) | GLSGNYVMDY (495) | RASDNIYSNLA (513) | YASIQES (514) | GGYDSRAWFRGAMAY (515) |
| | NIYPGSGSTKYDERFKS (516) | GLSGNYVVDY (517) | RARQSVSTS (518) | STS(N/R)L(A/H)S (519) | (Q/R)G(A/G)(L/Y)(Y/G)(D/Y)(G/D)(Y/G)(Y/G)(F or Absent)DH (520) |
| | (S/G)I(S/L)NGGDNTYY(P/N)D(K/T)VKG (521) | GLSGNFVMDF (522) | TT(S/G)S(V/D)(P/I)(S/T)NY(F/L)N (523) | | QQSNEAPPT (524) |
| | VISPYSGRTNYNQNFKG (525) | GTRAYHY (526) | | | QQSNEGPPT (527) |
| | EIAPTNGRTNYIEKFKS (528) | GTRAYHF (529) | | | GISTYFGRTNYNQKFK (530) |
| | VISFYSGKTNYNQKFMG (531) | GTRAYHY (526) | | | QHSNEDPPT (533) |
| | VISPYSGKTNYSQKFKG (534) | GTRAYHF (529) | | | QHFWGTPLT (510) |
| | EINPTNGRTNYIEKFK (537) | GGYDSRAWFAY (538) | | | QHFWGTPLM (539) |
| | EINPTNGRTNYNENFKS (540) | GGYDSRAWFAH (541) | | | QQHNEYPWT (542) |
| | EINPINGRTNYSEKFKK (543) | QGALYDGYYRGAMDY (544) | | | QHTWEIPFT (545) |
| | YISYSGTTSYNPSLKS (546) | RFFYFYDGEFAY (547) | | | HQYHRSPFT (548) |
| | NIYPGSGSTKYDERFKS (516) | | | | QQANTLPYT (550) |
| | NIYPGSGSTKYDEKFKS (551) | | | | QHTWEIPFT (552) |
| | SISNGGDNTYYPDTVK (553) | | | | HQ(Y/A)(H/N)(R/T)(S/L)PYT (554) |
| | EILPGSGSTKYNEKFKG (555) | | | | QQSNEAPPT (556) |
| | | | | | QHFAGTPLT (557) |

Group B

| VH | | | VL | | |
|---|---|---|---|---|---|
| CDR1 (SEQ ID NO) | CDR2 (SEQ ID NO) | CDR3 (SEQ ID NO) | CDR1 (SEQ ID NO) | CDR2 (SEQ ID NO) | CDR3 (SEQ ID NO) |
| GFTFSNYGMH (558) | MIYYDSSKMNYADTVKG (559) | PTSHYVVDV (560) | | | |
| GFTFSNYGMH (561) | MIYYDSSKMNYADTVKG (559) | PTSHYVVDV (563) | | | |

TABLE 13-continued

CDR Sequences for Antibodies and Activatable Antibodies that Bind CD71

| | | |
|---|---|---|
| GYTFTNYDIH (564) | MIYYDSSK MNYADTVK G (559) WIYPGDGS TKYNEKFK G (567) | PTSHYVVDV (566 YWGQGTTV (578) |

Group C

| VH | | | VL | | |
|---|---|---|---|---|---|
| CDR1 (SEQ ID NO) | CDR2 (SEQ ID NO) | CDR3 (SEQ ID NO) | CDR1 (SEQ ID NO) | CDR2 (SEQ ID NO) | CDR3 (SEQ ID NO) |
| TYTMH (579) | DIAYDGSTKY YADSVKG (580) | DAVAGEGYFDL (581) | QGDSLRSYY AS (582) | RNNQRPS (583) | AAWDDSLSAWV (584) |
| ASGMH (585) | FIAYDGNQKF YADSVKG (586) | EMQREGYFDY (587) | QGDSLRSYY AS (582) | GKNNRPS (589) | ATWDDNLSGPI (590) |
| DYYMS (591) | YISTSGSSIY YVDSVKG (592) | DLHGDYAFDS (593) | QGDSLRSYY AS (582) | GKNNRPS (589) | ATWDDNLSGPI (590) |
| SYAMS (597) | AISGSGGSTY YADSVKG (598) | VSSSWSHFDY (599) | RASQYISNW LA (600) | KASSLES (601) | QESYNTPLFT (602) |
| NYAIN (503) | NIHHDGNGKY YVDSVEG (604) | DGYGGYLDL (605) | QGDSLRSYY AS (582) | GKNNRPS (589) | AAWDDSLSGPV (608) |
| SYAMH (609) | VISYDGSNKY YADSVKG (610) | DLSGYGDYPDY (611) | QGDSLRSYY AS (582) | GRNERPS (613) | AGWDDSLTGPV (614) |

Group D

| VH | | | VL | | |
|---|---|---|---|---|---|
| CDR1 (SEQ ID NO) | CDR2 (SEQ ID NO) | CDR3 (SEQ ID NO) | CDR1 (SEQ ID NO) | CDR2 (SEQ ID NO) | CDR3 (SEQ ID NO) |
| Any of the VH CDR combinations shown in paragraphs [0060], [00150] and/or [00151] of US Patent Application Publication No. 2014/0114054 | | | Any of the VL CDR combinations shown in paragraph [0060], [00150] and/or [00151] of U.S. Patent Application Publication No. 2014/0114054 | | |
| TSGVGVG (439) | LIYWDDDKHY SPSLKS (441) | NGDYGIEFDY (486) | GGNNIGSKS VH (512) | YDSDRPS (516) | QVWDSSSDHVV (532) |
| SYSMN (535) | SISSSSSYIY YADSVKG (536) | ARESVDAFDI (562) | QGDSLRSYD AS (565) | GLSDRPS (588) | ISRDSGGNPH (594) |
| SYAMS (597) | AISGSGGSTY YADSVKG (598) | GYYGSNYYGM DV (595) | SGSSSNIGS NYVY (596) | RNNQRPS (583) | AAWDDSLSGPV (608) |
| DFVFS (606) | WISAHDGNTN YAQKLQD (607) | DTFTNLLDGYS YDAMDV (612) | GSSTGAVTS GHYPY (909) | DTTEKHS (910) | LLSSGDGRAV (911) |
| NYGMS (912) | WISAYNGNTN YGEKLQG (913) | DDYYGSGVDAF DI (914) | GGNKIGSKS VH (915) | YDRDRPS (916) | QVWDSSSDVV (917) |
| SYGMH (918) | VISFDGSSKY YADSVKG (919) | DSNFWSGYYSP VDV (920) | TRSSGSIAS NSVQ (921) | YEDTQRPS (922) | QSYDSAYHWV (923) |
| SYWLS (924) | KIDPSDSYTQ YSPSFEG (925) | HGYDAFHV (926) | SGSSSNIGN NAVN (927) | YDDLLPS (928) | AAWDDSLNGWV (929) |
| DYAMH (930) | GISWNSGSIG YADSVKG (931) | DQHREFYYYGM DV (932) | SGSSSNIGS NYVY (596) | RNNQRPS (583) | AAWDDSLSGPV (608) |
| SYWIG (933) | IIYPGDSDTR YSGSFQG (934) | QGTNWGVGDAF DI (935) | GGNNIGSKS VH (512) | DDSDRPS (936) | QVWDISSDHVV (937) |
| SYAMS (597) | AISGSGGSTY YADSVKG (598) | DRYYYGSGSYY DAFDI (938) | QGDSLRSYY AS (592) | GKNNRPS (589) | NSRDSSGNHVV (929) |

TABLE 13-continued

CDR Sequences for Antibodies and Activatable Antibodies that Bind CD71

| SYSMN (535) | VISYDGSNKY YADSVKG (610) | VDPGDRGWYFDL (940) | SGSSSNIGSNTVN (941) | SNNQRPS (942) | AAWDDSLNGWV (929) |
|---|---|---|---|---|---|
| SSPYYWG (943) | SVYYSGNTYYNPSLTR (944) | HSWGINDAFDV (945) | SGSSSNIGNNVYS (946) | DNNKRPS (947) | GTWDSSLSVWV (948) |
| DYAMH (930) | GISWNSGSIDYADSVKG (949) | ENLAVAGLDY (950) | QGDSLRGYYAS (951) | DKNTRPS (952) | QSRDNSGEMVV (953) |
| ELSMH (954) | GFDPEDGETIYAQKFQG (955) | DAYYGSGSPRDAFDI (956) | GGDNVGGKSLH (957) | DDRDRPS (958) | QVWDDISRLVI (959) |
| SYYIH (960) | IINPRGGGTDFAQKFQG (961) | GDCTNGVCYSGGLDV (962) | SGSSSNIGNNYVS (946) | DNDKRPS (963) | GTWDNSLSGV (964) |
| DYAMH (930) | GISWNSGSIGYADSVKG (931) | DVDLWFGEYYFDY (965) | SGSSSNIGNNYVS (946) | DNNKRPS (947) | GTWDSSLSAPYV (966) |
| DYAMY (967) | GINWNSAIIGYADSVKG (968) | EALYYSAFFDS (969) | SGSSSNIGNNYVS (946) | DNNKRPS (947) | GTWDSSLSAWV (970) |
| DYAMH (930) | GINWNGGSTDYADSVEG (971) | DYADLGSGSDY (972) | SGSRSNIGSNYVH (973) | RNDQRPS (974) | ASWDDKMSGRL (975) |
| SYEMN (976) | YISSSGSTIYYADSVKG (977) | HSNYDILTGYSTDAFDI (978) | TGTSSDIGFYDSVS (979) | DVSNRPS (980) | TSNTKTNTLYV (981) |
| RGNYWWT (982) | SVHYSGSTNYNPSLKS (983) | DSDYGDYYFDY (948) | QGDSLRSYYAS (582) | GKNNRPS (589) | NSRDSSGNHVV (939) |

Group E

| VH | | | VL | | |
|---|---|---|---|---|---|
| CDR1 (SEQ ID NO) | CDR2 (SEQ ID NO) | CDR3 (SEQ ID NO) | CDR1 (SEQ ID NO) | CDR2 (SEQ ID NO) | CDR3 (SEQ ID NO) |
| SYGMH (918) | VISFDGSSKYYADSVK (919) | DGNFWSGYYSPVDV (1026) | TRSSGSIASNSVQ (921) | YEDTQRPS (922) | QSYDSAYHWV (923) |
| SYGMH (918) | VISFDGSSKYYADSVK (919) | DSAFWSGYYSPVDV (991) | | | |
| SYGMH (918) | VISFDGSSKYYADSVK (919) | DSNLWSGYYSPVDV (992) | | | |
| SYGMH (918) | VISFDGSSKYYADSVK (919) | DSNFWGGYYSPVDV (993) | | | |
| SYGMH (918) | VISFDGSSKYYADSVK (919) | DSALWGGYYSPVDV (994) | | | |
| SYGMH (918) | VISFDGSSKYYADSVK (919) | DGNLWGGYYSPVDV (995) | | | |
| SYGMH (918) | VISFDGSSKYYADSVK (919) | DGAFWGGYYSPVDV (996) | | | |
| SYGMH (918) | VISFDGSSKYYADSVK (919) | DGALWSGYYSPVDV (997) | | | |
| SYGMH (918) | VISFDGSSKYYADSVK (919) | DGALWGGYYSPVDVD (998) | | | |
| SYGMH (918) | VIDYDGSSKYYADSVKG (1027) | DSNFWSGYYSPVDV (920) | | | |
| SYGMH (918) | VISYDGSNKYYADSVKG (610) | DSNFWSGYYSPVDV (920) | | | |

TABLE 13-continued

CDR Sequences for Antibodies and Activatable Antibodies that Bind CD71

| Group F | | | | | | |
|---|---|---|---|---|---|---|
| VH | | | VL | | | |
| CDR1 (SEQ ID NO) | CDR2 (SEQ ID NO) | CDR3 (SEQ ID NO) | CDR1 (SEQ ID NO) | CDR2 (SEQ ID NO) | | CDR3 (SEQ ID NO) |
| FSLSSY (1028) | WS | GTSYPDYGDAN GFD (1029) | SQSISSY (1030) | RAS (1031) | | CYSSSNVDN (1032) |
| GFNIKDT (1033) | ANG | YLYPYYFD (1034) | SESVDTY (1035) | GAS | | TYNYPL (1036) |

In some embodiments, the activatable anti-CD71 antibody comprises or is derived from an antibody that is manufactured, secreted or otherwise produced by a hybridoma, such as, for example, the hybridoma(s) designated BA120 as disclosed in U.S. Pat. No. 7,736,647 and deposited at the Collection Nationale de Cultures de Microorganismes (CNCM) (Institut Pasteur, Paris, France, 25, Rue du Docteur Roux, F-75724, Paris, Cedex 15) on Jun. 14, 2005, under number CNCM I-3449; the hybridoma(s) disclosed in U.S. Pat. No. 7,572,895 and deposited at the ATCC under PTA-6055; the hybridoma(s) disclosed in PCT Publication No. WO 2014/020140 and WO 2005/111082 and deposited with CNCM on May 10, 2001, under number 1-2665; the hybridoma(s) disclosed in U.S. Pat. No. 4,434,156 and deposited at the ATCC under HB-8094; the hybridoma(s) disclosed in U.S. Pat. No. 5,648,469 and deposited at the ATCC under HB-11011 and HB-11010.

The anti-CD71 antibodies and the ABs in the activatable antibodies of the disclosure specifically bind a CD71 target, such as, for example, mammalian CD71, and/or human CD71. Also included in the disclosure are anti-CD71 antibodies and ABs that bind to the same CD71 epitope as an antibody of the disclosure and/or an activated activatable antibody described herein. Also included in the disclosure are anti-CD71 antibodies and ABs that compete with an anti-CD71 antibody and/or an activated anti-CD71 activatable antibody described herein for binding to a CD71 target, e.g., human CD71. Also included in the disclosure are anti-CD71 antibodies and ABs that cross-compete with an anti-CD71 antibody and/or an activated anti-CD71 activatable antibody described herein for binding to a CD71 target, e.g., human CD71.

The activatable anti-CD71 antibodies provided herein include a masking moiety. In some embodiments, the masking moiety is an amino acid sequence that is coupled or otherwise attached to the anti-CD71 antibody and is positioned within the activatable anti-CD71 antibody construct such that the masking moiety reduces the ability of the anti-CD71 antibody to specifically bind CD71. Suitable masking moieties are identified using any of a variety of known techniques. For example, peptide masking moieties are identified using the methods described in PCT Publication No. WO 2009/025846 by Daugherty et al., the contents of which are hereby incorporated by reference in their entirety.

The activatable anti-CD71 antibodies provided herein include a cleavable moiety. In some embodiments, the cleavable moiety includes an amino acid sequence that is a substrate for a protease, usually an extracellular protease. Suitable substrates are identified using any of a variety of known techniques. For example, peptide substrates are identified using the methods described in U.S. Pat. No. 7,666,817 by Daugherty et al.; in U.S. Pat. No. 8,563,269 by Stagliano et al.; and in PCT Publication No. WO 2014/026136 by La Porte et al., the contents of each of which are hereby incorporated by reference in their entirety. (See also Boulware et al. "Evolutionary optimization of peptide substrates for proteases that exhibit rapid hydrolysis kinetics." Biotechnol Bioeng. 106.3 (2010): 339-46).

Exemplary substrates include but are not limited to substrates cleavable by one or more of the following enzymes or proteases listed in Table 4.

TABLE 4

Exemplary Proteases and/or Enzymes

ADAMS, ADAMTS, e.g.,
ADAM8
ADAM9
ADAM10
ADAM12
ADAM15
ADAM17/TACE
ADAMDEC1
ADAMTS1
ADAMTS4
ADAMTS5
Aspartate proteases, e.g.,
BACE
Renin
Aspartic cathepsins, e.g.,
Cathepsin D
Cathepsin E
Caspases, e.g.,
Caspase 1
Caspase 2
Caspase 3
Caspase 4
Caspase 5
Caspase 6
Caspase 7
Caspase 8
Caspase 9
Caspase 10
Caspase 14
Cysteine cathepsins, e.g.,
Cathepsin B
Cathepsin C
Cathepsin K
Cathepsin L
Cathepsin S
Cathepsin V/L2
Cathepsin X/Z/P
Cysteine proteinases, e.g.,
Cruzipain
Legumain
Otubain-2
KLKs, e.g., TABLE 4-continued Exemplary Proteases and/or Enzymes KLK4
KLK5
KLK6
KLK7
KLK8
KLK10
KLK11
KLK13
KLK14
Metallo proteinases, e.g.,
Meprin
Neprilysin
PSMA
BMP-1
MMPs, e.g.,
MMP1
MMP2
MMP3
MMP7
MMP8
MMP9
MMP10
MMP11
MMP12
MMP13
MMP14
MMP15
MMP16
MMP17
MMP19
MMP20
MMP23
MMP24
MMP26
MMP27
Serine proteases, e.g.,
activated protein C
Cathepsin A
Cathepsin G
Chymase
coagulation factor proteases
(e.g., FVIIa, FIXa, FXa, FXIa, FXIIa)
Elastase
Granzyme B
Guanidinobenzoatase
HtrA1
Human Neutrophil Elastase
Lactoferrin
Marapsin
NS3/4A
PACE4
Plasmin
PSA
tPA
Thrombin
Tryptase
uPA
Type II Transmembrane
Serine Proteases (TTSPs), e.g.,
DESC1
DPP-4
FAP
Hepsin
Matriptase-2
MT-SP1/Matriptase
TMPRSS2
TMPRSS3
TMPRSS4

The activatable anti-CD71 antibodies described herein overcome a limitation of antibody therapeutics, particularly antibody therapeutics that are known to be toxic to at least some degree in vivo. Target-mediated toxicity constitutes a major limitation for the development of therapeutic antibodies. The activatable anti-CD71 antibodies provided herein are designed to address the toxicity associated with the inhibition of the target in normal tissues by traditional therapeutic antibodies. These activatable anti-CD71 antibodies remain masked until proteolytically activated at the site of disease. Starting with an anti-CD71 antibody as a parental therapeutic antibody, the activatable anti-CD71 antibodies of the invention were engineered by coupling the antibody to an inhibitory mask through a linker that incorporates a protease substrate.

When the AB is modified with a MM and is in the presence of the target, specific binding of the AB to its target is reduced or inhibited, as compared to the specific binding of the AB not modified with an MM or the specific binding of the parental AB to the target.

The $K_d$ of the AB modified with a MM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times greater than the $K_d$ of the AB not modified with an MM or of the parental AB towards the target. Conversely, the binding affinity of the AB modified with a MM towards the target is at least 2, 3, 4, 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the AB not modified with an MM or of the parental AB towards the target.

The dissociation constant ($K_d$) of the MM towards the AB is generally greater than the $K_d$ of the AB towards the target. The $K_d$ of the MM towards the AB can be at least 5, 10, 25, 50, 100, 250, 500, 1,000, 2,500, 5,000, 10,000, 100,000, 1,000,000 or even 10,000,000 times greater than the $K_d$ of the AB towards the target. Conversely, the binding affinity of the MM towards the AB is generally lower than the binding affinity of the AB towards the target. The binding affinity of MM towards the AB can be at least 5, 10, 25, 50, 100, 250, 500, 1,000, 2,500, 5,000, 10,000, 100,000, 1,000.000 or even 10,000,000 times lower than the binding affinity of the AB towards the target.

In some embodiments, the dissociation constant ($K_d$) of the MM towards the AB is approximately equal to the $K_d$ of the AB towards the target. In some embodiments, the dissociation constant ($K_d$) of the MM towards the AB is no more than the dissociation constant of the AB towards the target.

In some embodiments, the dissociation constant ($K_d$) of the MM towards the AB is less than the dissociation constant of the AB towards the target.

In some embodiments, the dissociation constant ($K_d$) of the MM towards the AB is greater than the dissociation constant of the AB towards the target.

In some embodiments, the MM has a $K_d$ for binding to the AB that is no more than the $K_d$ for binding of the AB to the target.

In some embodiments, the MM has a $K_d$ for binding to the AB that is no less than the $K_d$ for binding of the AB to the target.

In some embodiments, the MM has a $K_d$ for binding to the AB that is approximately equal to the $K_d$ for binding of the AB to the target.

In some embodiments, the MM has a $K_d$ for binding to the AB that is less than the $K_d$ for binding of the AB to the target.

In some embodiments, the MM has a $K_d$ for binding to the AB that is greater than the $K_d$ for binding of the AB to the target.

In some embodiments, the MM has a $K_d$ for binding to the AB that is no more than 2, 3, 4, 5, 10, 25, 50, 100, 250, 500, or 1,000 fold greater than the $K_d$ for binding of the AB to the target. In some embodiments, the MM has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to the target.

In some embodiments, the MM has an affinity for binding to the AB that is less than the affinity of binding of the AB to the target.

In some embodiments, the MM has an affinity for binding to the AB that is no more than the affinity of binding of the AB to the target.

In some embodiments, the MM has an affinity for binding to the AB that is approximately equal of the affinity of binding of the AB to the target.

In some embodiments, the MM has an affinity for binding to the AB that is no less than the affinity of binding of the AB to the target.

In some embodiments, the MM has an affinity for binding to the AB that is greater than the affinity of binding of the AB to the target.

In some embodiments, the MM has an affinity for binding to the AB that is 2, 3, 4, 5, 10, 25, 50, 100, 250, 500, or 1,000 less than the affinity of binding of the AB to the target. I In some embodiments, the MM has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to the target. In some embodiments, the MM has an affinity for binding to the AB that is 2 to 20 fold less than the affinity of binding of the AB to the target. In some embodiments, a MM not covalently linked to the AB and at equimolar concentration to the AB does not inhibit the binding of the AB to the target.

When the AB is modified with a MM and is in the presence of the target specific binding of the AB to its target is reduced or inhibited, as compared to the specific binding of the AB not modified with an MM or the specific binding of the parental AB to the target. When compared to the binding of the AB not modified with an MM or the binding of the parental AB to the target the AB's ability to bind the target when modified with an MM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or more when measured in vivo or in an in vitro assay.

The MM inhibits the binding of the AB to the target. The MM binds the antigen binding domain of the AB and inhibits binding of the AB to the target. The MM can sterically inhibit the binding of the AB to the target. The MM can allosterically inhibit the binding of the AB to its target. In these embodiments when the AB is modified or coupled to a MM and in the presence of target there is no binding or substantially no binding of the AB to the target, or no more than 0.001%, 0.01%, 0.1%, 1%, 2%, 3%, 4%, 5%, 6%, 7%, 8%, 9%, 10%, 15%, 20%, 25%, 30%, 35%, 40%, or 50% binding of the AB to the target, as compared to the binding of the AB not modified with an MM, the parental AB, or the AB not coupled to an MM to the target, for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

When an AB is coupled to or modified by a MM, the MM 'masks' or reduces or otherwise inhibits the specific binding of the AB to the target. When an AB is coupled to or modified by a MM, such coupling or modification can effect a structural change that reduces or inhibits the ability of the AB to specifically bind its target.

An AB coupled to or modified with an MM can be represented by the following formulae (in order from an amino (N) terminal region to carboxyl (C) terminal region:

(MM)-(AB)

(AB)-(MM)

(MM)-L-(AB)

(AB)-L-(MM)

where MM is a masking moiety, the AB is an antibody or antibody fragment thereof, and the L is a linker. In many embodiments, it can be desirable to insert one or more linkers, e.g., flexible linkers, into the composition so as to provide for flexibility.

In certain embodiments, the MM is not a natural binding partner of the AB. In some embodiments, the MM contains no or substantially no homology to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 25% identical to any natural binding partner of the AB. In some embodiments, the MM is no more than 50% identical to any natural binding partner of the AB. In some embodiments, the MM is no more than 20% identical to any natural binding partner of the AB. In some embodiments, the MM is no more than 10% identical to any natural binding partner of the AB.

In some embodiments, the activatable antibodies include an AB that is modified by an MM and also includes one or more cleavable moieties (CM). Such activatable antibodies exhibit activatable/switchable binding, to the AB's target. Activatable antibodies generally include an antibody or antibody fragment (AB), modified by or coupled to a masking moiety (MM) and a modifiable or cleavable moiety (CM). In some embodiments, the CM contains an amino acid sequence that serves as a substrate for at least one protease.

The elements of the activatable antibodies are arranged so that the MM and CM are positioned such that in a cleaved (or relatively active) state and in the presence of a target, the AB binds a target while the activatable antibody is in an uncleaved (or relatively inactive) state in the presence of the target, specific binding of the AB to its target is reduced or inhibited. The specific binding of the AB to its target can be reduced due to the inhibition or masking of the AB's ability to specifically bind its target by the MM.

The $K_d$ of the AB modified with a MM and a CM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100, 000, 1,000-1,000,000, 1000-10,000,000, 10,000-100,000, 10,000-1,000,000, 10,000-10,000,000, 100,000-1,000,000, or 100,000-10,000,000 times greater than the $K_d$ of the AB not modified with an MM and a CM or of the parental AB towards the target. Conversely, the binding affinity of the AB modified with a MM and a CM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the AB not modified with an MM and a CM or of the parental AB towards the target.

When the AB is modified with a MM and a CM and is in the presence of the target but not in the presence of a modifying agent (for example at least one protease), specific binding of the AB to its target is reduced or inhibited, as compared to the specific binding of the AB not modified with an MM and a CM or of the parental AB to the target. When compared to the binding of the parental AB or the binding of an AB not modified with an MM and a CM to its target, the AB's ability to bind the target when modified with an MM and a CM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

As used herein, the term cleaved state refers to the condition of the activatable antibodies following modification of the CM by at least one protease. The term uncleaved state, as used herein, refers to the condition of the activatable antibodies in the absence of cleavage of the CM by a protease. As discussed above, the term "activatable antibodies" is used herein to refer to an activatable antibody in both its uncleaved (native) state, as well as in its cleaved state. It will be apparent to the ordinarily skilled artisan that in some embodiments a cleaved activatable antibody may lack an MM due to cleavage of the CM by protease, resulting in release of at least the MM (e.g., where the MM is not joined to the activatable antibodies by a covalent bond (e.g., a disulfide bond between cysteine residues).

By activatable or switchable is meant that the activatable antibody exhibits a first level of binding to a target when the activatable antibody is in a inhibited, masked or uncleaved state (i.e., a first conformation), and a second level of binding to the target in the uninhibited, unmasked and/or cleaved state (i.e., a second conformation), where the second level of target binding is greater than the first level of binding. In general, the access of target to the AB of the activatable antibody is greater in the presence of a cleaving agent capable of cleaving the CM, i.e., a protease, than in the absence of such a cleaving agent. Thus, when the activatable antibody is in the uncleaved state, the AB is inhibited from target binding and can be masked from target binding (i.e., the first conformation is such the AB cannot bind the target), and in the cleaved state the AB is not inhibited or is unmasked to target binding.

The CM and AB of the activatable antibodies are selected so that the AB represents a binding moiety for a given target, and the CM represents a substrate for a protease. In some embodiments, the protease is co-localized with the target at a treatment site or diagnostic site in a subject. As used herein, co-localized refers to being at the same site or relatively close nearby. In some embodiments, a protease cleaves a CM yielding an activated antibody that binds to a target located nearby the cleavage site. The activatable antibodies disclosed herein find particular use where, for example, a protease capable of cleaving a site in the CM, i.e., a protease, is present at relatively higher levels in target-containing tissue of a treatment site or diagnostic site than in tissue of non-treatment sites (for example in healthy tissue). In some embodiments, a CM of the disclosure is also cleaved by one or more other proteases. In some embodiments, it is the one or more other proteases that is co-localized with the target and that is responsible for cleavage of the CM in vivo.

In some embodiments activatable antibodies provide for reduced toxicity and/or adverse side effects that could otherwise result from binding of the AB at non-treatment sites if the AB were not masked or otherwise inhibited from binding to the target.

In general, an activatable antibody can be designed by selecting an AB of interest and constructing the remainder of the activatable antibody so that, when conformationally constrained, the MM provides for masking of the AB or reduction of binding of the AB to its target. Structural design criteria can be to be taken into account to provide for this functional feature.

Activatable antibodies exhibiting a switchable phenotype of a desired dynamic range for target binding in an inhibited versus an uninhibited conformation are provided. Dynamic range generally refers to a ratio of (a) a maximum detected level of a parameter under a first set of conditions to (b) a minimum detected value of that parameter under a second set of conditions. For example, in the context of an activatable antibody, the dynamic range refers to the ratio of (a) a maximum detected level of target protein binding to an activatable antibody in the presence of at least one protease capable of cleaving the CM of the activatable antibodies to (b) a minimum detected level of target protein binding to an activatable antibody in the absence of the protease. The dynamic range of an activatable antibody can be calculated as the ratio of the dissociation constant of an activatable antibody cleaving agent (e.g., enzyme) treatment to the dissociation constant of the activatable antibodies cleaving agent treatment. The greater the dynamic range of an activatable antibody, the better the switchable phenotype of the activatable antibody. Activatable antibodies having relatively higher dynamic range values (e.g., greater than 1) exhibit more desirable switching phenotypes such that target protein binding by the activatable antibodies occurs to a greater extent (e.g., predominantly occurs) in the presence of a cleaving agent (e.g., enzyme) capable of cleaving the CM of the activatable antibodies than in the absence of a cleaving agent.

Activatable antibodies can be provided in a variety of structural configurations. Exemplary formulae for activatable antibodies are provided below. It is specifically contemplated that the N- to C-terminal order of the AB, MM and CM can be reversed within an activatable antibody. It is also specifically contemplated that the CM and MM may overlap in amino acid sequence, e.g., such that the CM is contained within the MM.

For example, activatable antibodies can be represented by the following formula (in order from an amino (N) terminal region to carboxyl (C) terminal region:

(MM)-(CM)-(AB)

(AB)-(CM)-(MM)

where MM is a masking moiety, CM is a cleavable moiety, and AB is an antibody or fragment thereof. It should be noted that although MM and CM are indicated as distinct components in the formulae above, in all exemplary embodiments (including formulae) disclosed herein it is contemplated that the amino acid sequences of the MM and the CM could overlap, e.g., such that the CM is completely or partially contained within the MM. In addition, the formulae above provide for additional amino acid sequences that can be positioned N-terminal or C-terminal to the activatable antibodies elements.

In certain embodiments, the MM is not a natural binding partner of the AB. In some embodiments, the MM contains no or substantially no homology to any natural binding partner of the AB. In some embodiments, the MM is no more than 50%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 50% identical to any natural binding partner of the AB. In some embodiments, the MM is no more than 25% identical to any natural binding partner of the AB. In some embodiments, the MM is no more than 20% identical to any natural binding partner of the AB. In some embodiments, the MM is no more than 10% identical to any natural binding partner of the AB.

In many embodiments it may be desirable to insert one or more linkers, e.g., flexible linkers, into the activatable antibody construct so as to provide for flexibility at one or more of the MM-CM junction, the CM-AB junction, or both. For example, the AB, MM, and/or CM may not contain a sufficient number of residues (e.g., Gly, Ser, Asp, Asn, especially Gly and Ser, particularly Gly) to provide the desired flexibility. As such, the switchable phenotype of such activatable antibody constructs may benefit from introduction of one or more amino acids to provide for a flexible linker. In addition, as described below, where the activatable antibody is provided as a conformationally constrained construct, a flexible linker can be operably inserted to facilitate formation and maintenance of a cyclic structure in the uncleaved activatable antibody.

For example, in certain embodiments an activatable antibody comprises one of the following formulae (where the formula below represent an amino acid sequence in either N- to C-terminal direction or C- to N-terminal direction):

(MM)-L1-(CM)-(AB)
(MM)-(CM)-L2-(AB)
(MM)-L1-(CM)-L2-(AB)

wherein MM, CM, and AB are as defined above; wherein L1 and L2 are each independently and optionally present or absent, are the same or different flexible linkers that include at least 1 flexible amino acid (e.g., Gly). In addition, the formulae above provide for additional amino acid sequences that can be positioned N-terminal or C-terminal to the activatable antibodies elements. Examples include, but are not limited to, targeting moieties (e.g., a ligand for a receptor of a cell present in a target tissue) and serum half-life extending moieties (e.g., polypeptides that bind serum proteins, such as immunoglobulin (e.g., IgG) or serum albumin (e.g., human serum albumin (HAS)).

The CM is specifically cleaved by at least one protease at a rate of about $0.001$-$1500 \times 10^4$ $M^{-1}S^{-1}$ or at least 0.001, 0.005, 0.01, 0.05, 0.1, 0.5, 1, 2.5, 5, 7.5, 10, 15, 20, 25, 50, 75, 100, 125, 150, 200, 250, 500, 750, 1000, 1250, or $1500 \times 10^4$ $M^{-1}S^{-1}$. In some embodiments, the CM is specifically cleaved at a rate of about 100,000 $M^{-1}S^{-1}$. In some embodiments, the CM is specifically cleaved at a rate from about $1 \times 10E2$ to about $1 \times 10E6$ $M^{-1}S^{-1}$ (i.e., from about $1 \times 10^2$ to about $1 \times 10^6$ $M^{-1}S^{-1}$).

For specific cleavage by an enzyme, contact between the enzyme and CM is made. When the activatable antibody comprising an AB coupled to a MM and a CM is in the presence of target and sufficient enzyme activity, the CM can be cleaved. Sufficient enzyme activity can refer to the ability of the enzyme to make contact with the CM and effect cleavage. It can readily be envisioned that an enzyme may be in the vicinity of the CM but unable to cleave because of other cellular factors or protein modification of the enzyme.

Linkers suitable for use in compositions described herein are generally ones that provide flexibility of the modified AB or the activatable antibodies to facilitate the inhibition of the binding of the AB to the target. Such linkers are generally referred to as flexible linkers. Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and can be 1, 2, 3, 4, 5, 6, 7, 8, 9, 10, 11, 12, 13, 14, 15, 16, 17, 18, 19, or 20 amino acids in length.

Exemplary flexible linkers include glycine polymers (G)n, glycine-serine polymers (including, for example, (GS)n, (GSGGS)n (SEQ ID NO: 339) and (GGGS)n (SEQ ID NO: 340), where n is an integer of at least one), glycine-alanine polymers, alanine-serine polymers, and other flexible linkers known in the art. Glycine and glycine-serine polymers are relatively unstructured, and therefore may be able to serve as a neutral tether between components. Glycine accesses significantly more phi-psi space than even alanine, and is much less restricted than residues with longer side chains (see Scheraga, Rev. Computational Chem. 11173-142 (1992)). Exemplary flexible linkers include, but are not limited to Gly-Gly-Ser-Gly (SEQ ID NO: 341), Gly-Gly-Ser-Gly-Gly (SEQ ID NO: 342), Gly-Ser-Gly-Ser-Gly (SEQ ID NO: 343), Gly-Ser-Gly-Gly-Gly (SEQ ID NO: 344), Gly-Gly-Gly-Ser-Gly (SEQ ID NO: 345), Gly-Ser-Ser-Ser-Gly (SEQ ID NO: 346), and the like. The ordinarily skilled artisan will recognize that design of an activatable antibodies can include linkers that are all or partially flexible, such that the linker can include a flexible linker as well as one or more portions that confer less flexible structure to provide for a desired activatable antibodies structure.

The disclosure also provides compositions and methods that include an activatable anti-CD71 antibody that includes an antibody or antibody fragment (AB) that specifically binds CD71, where the AB is coupled to a masking moiety (MM) that decreases the ability of the AB to bind its target. In some embodiments, the activatable anti-CD71 antibody further includes a cleavable moiety (CM) that is a substrate for a protease. The compositions and methods provided herein enable the attachment of one or more agents to one or more cysteine residues in the AB without compromising the activity (e.g., the masking, activating or binding activity) of the activatable anti-CD71 antibody. In some embodiments, the compositions and methods provided herein enable the attachment of one or more agents to one or more cysteine residues in the AB without reducing or otherwise disturbing one or more disulfide bonds within the MM. The compositions and methods provided herein produce an activatable anti-CD71 antibody that is conjugated to one or more agents, e.g., any of a variety of therapeutic, diagnostic and/or prophylactic agents, for example, in some embodiments, without any of the agent(s) being conjugated to the MM of the activatable anti-CD71 antibody. The compositions and methods provided herein produce conjugated activatable anti-CD71 antibodies in which the MM retains the ability to effectively and efficiently mask the AB of the activatable antibody in an uncleaved state. The compositions and methods provided herein produce conjugated activatable anti-CD71 antibodies in which the activatable antibody is still activated, i.e., cleaved, in the presence of a protease that can cleave the CM.

The activatable anti-CD71 antibodies have at least one point of conjugation for an agent, but in the methods and compositions provided herein less than all possible points of conjugation are available for conjugation to an agent. In some embodiments, the one or more points of conjugation are sulfur atoms involved in disulfide bonds. In some embodiments, the one or more points of conjugation are sulfur atoms involved in interchain disulfide bonds. In some embodiments, the one or more points of conjugation are sulfur atoms involved in interchain sulfide bonds, but not sulfur atoms involved in intrachain disulfide bonds. In some embodiments, the one or more points of conjugation are sulfur atoms of cysteine or other amino acid residues containing a sulfur atom. Such residues may occur naturally in the antibody structure or can be incorporated into the antibody by site-directed mutagenesis, chemical conversion, or mis-incorporation of non-natural amino acids.

Also provided are methods of preparing a conjugate of an activatable anti-CD71 antibody having one or more interchain disulfide bonds in the AB and one or more intrachain disulfide bonds in the MM, and a drug reactive with free thiols is provided. The method generally includes partially reducing interchain disulfide bonds in the activatable antibody with a reducing agent, such as, for example, TCEP; and conjugating the drug reactive with free thiols to the partially reduced activatable antibody. As used herein, the term partial reduction refers to situations where an activatable anti-CD71 antibody is contacted with a reducing agent and less than all disulfide bonds, e.g., less than all possible sites of conjugation are reduced. In some embodiments, less than 99%, 98%, 97%, 96%, 95%, 90%, 85%, 80%, 75%, 70%, 65%, 60%, 55%, 50%, 45%, 40%, 35%, 30%, 25%, 20%, 15%, 10% or less than 5% of all possible sites of conjugation are reduced.

In yet other embodiments, a method of reducing and conjugating an agent, e.g., a drug, to an activatable anti-CD71 antibody resulting in selectivity in the placement of the agent is provided. The method generally includes partially reducing the activatable anti-CD71 antibody with a reducing agent such that any conjugation sites in the masking moiety or other non-AB portion of the activatable antibody are not reduced, and conjugating the agent to interchain thiols in the AB. The conjugation site(s) are selected so as to allow desired placement of an agent to allow conjugation to occur at a desired site. The reducing agent is, for example, TCEP. The reduction reaction conditions such as, for example, the ratio of reducing agent to activatable antibody, the length of incubation, the temperature during the incubation, the pH of the reducing reaction solution, etc., are determined by identifying the conditions that produce a conjugated activatable antibody in which the MM retains the ability to effectively and efficiently mask the AB of the activatable antibody in an uncleaved state. The ratio of reduction agent to activatable anti-CD71 antibody will vary depending on the activatable antibody. In some embodiments, the ratio of reducing agent to activatable anti-CD71 antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

In some embodiments, a method of reducing interchain disulfide bonds in the AB of an activatable anti-CD71 antibody and conjugating an agent, e.g., a thiol-containing agent such as a drug, to the resulting interchain thiols to selectively locate agent(s) on the AB is provided. The method generally includes partially reducing the AB with a reducing agent to form at least two interchain thiols without forming all possible interchain thiols in the activatable antibody; and conjugating the agent to the interchain thiols of the partially reduced AB. For example, the AB of the activatable antibody is partially reduced for about 1 hour at about 37° C. at a desired ratio of reducing agent:activatable antibody. In some embodiments, the ratio of reducing agent to activatable antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

The thiol-containing reagent can be, for example, cysteine or N-acetyl cysteine. The reducing agent can be, for example, TCEP. In some embodiments, the reduced activatable antibody can be purified prior to conjugation, using for example, column chromatography, dialysis, or diafiltration. Alternatively, the reduced antibody is not purified after partial reduction and prior to conjugation.

The invention also provides partially reduced activatable anti-CD71 antibodies in which at least one interchain disulfide bond in the activatable antibody has been reduced with a reducing agent without disturbing any intrachain disulfide bonds in the activatable antibody, wherein the activatable antibody includes an antibody or an antigen binding fragment thereof (AB) that specifically binds to CD71, a masking moiety (MM) that inhibits the binding of the AB of the activatable antibody in an uncleaved state to the CD71 target, and a cleavable moiety (CM) coupled to the AB, wherein the CM is a polypeptide that functions as a substrate for a protease. In some embodiments the MM is coupled to the AB via the CM. In some embodiments, one or more intrachain disulfide bond(s) of the activatable antibody is not disturbed by the reducing agent. In some embodiments, one or more intrachain disulfide bond(s) of the MM within the activatable antibody is not disturbed by the reducing agent. In some embodiments, the activatable antibody in the uncleaved state has the structural arrangement from N-terminus to C-terminus as follows: MM-CM-AB or AB-CM-MM. In some embodiments, reducing agent is TCEP.

In yet other embodiments, a method of reducing and conjugating an agent, e.g., a drug, to an activatable anti-CD71 antibody resulting in selectivity in the placement of the agent by providing an activatable anti-CD71 antibody with a defined number and positions of lysine and/or cysteine residues. In some embodiments, the defined number of lysine and/or cysteine residues is higher or lower than the number of corresponding residues in the amino acid sequence of the parent antibody or activatable antibody. In some embodiments, the defined number of lysine and/or cysteine residues may result in a defined number of agent equivalents that can be conjugated to the anti-CD71 antibody or activatable anti-CD71 antibody. In some embodiments, the defined number of lysine and/or cysteine residues may result in a defined number of agent equivalents that can be conjugated to the anti-CD71 antibody or activatable anti-CD71 antibody in a site-specific manner. In some embodiments, the modified activatable antibody is modified with one or more non-natural amino acids in a site-specific manner, thus in some embodiments limiting the conjugation of the agents to only the sites of the non-natural amino acids. In some embodiments, the anti-CD71 antibody or activatable anti-CD71 antibody with a defined number and positions of lysine and/or cysteine residues can be partially reduced with a reducing agent as discussed herein such that any conjugation sites in the masking moiety or other non-AB portion of the activatable antibody are not reduced, and conjugating the agent to interchain thiols in the AB.

The disclosure also provides partially reduced activatable antibodies in which at least one interchain disulfide bond in the activatable antibody has been reduced with a reducing agent without disturbing any intrachain disulfide bonds in the activatable antibody, wherein the activatable antibody includes an antibody or an antigen binding fragment thereof (AB) that specifically binds to the target, e.g., CD71, a masking moiety (MM) that inhibits the binding of the AB of the activatable antibody in an uncleaved state to the target, and a cleavable moiety (CM) coupled to the AB, wherein the CM is a polypeptide that functions as a substrate for at least one protease. In some embodiments, the MM is coupled to the AB via the CM. In some embodiments, one or more intrachain disulfide bond(s) of the activatable antibody is not disturbed by the reducing agent. In some embodiments, one or more intrachain disulfide bond(s) of the MM within the activatable antibody is not disturbed by the reducing agent. In some embodiments, the activatable antibody in the uncleaved state has the structural arrangement from N-terminus to C-terminus as follows: MM-CM-AB or AB-CM-MM. In some embodiments, reducing agent is TCEP.

In some embodiments, the activatable antibodies described herein also include an agent conjugated to the activatable antibody. In some embodiments, the conjugated agent is a therapeutic agent, such as an anti-inflammatory and/or an antineoplastic agent. In such embodiments, the agent is conjugated to a carbohydrate moiety of the activatable antibody, for example, in some embodiments, where the carbohydrate moiety is located outside the antigen-binding region of the antibody or antigen-binding fragment in the activatable antibody. In some embodiments, the agent is conjugated to a sulfhydryl group of the antibody or antigen-binding fragment in the activatable antibody.

In some embodiments, the agent is a cytotoxic agent such as a toxin (e.g., an enzymatically active toxin of bacterial, fungal, plant, or animal origin, or fragments thereof), or a radioactive isotope (i.e., a radioconjugate).

In some embodiments, the agent is a detectable moiety such as, for example, a label or other marker. For example, the agent is or includes a radiolabeled amino acid, one or more biotinyl moieties that can be detected by marked avidin (e.g., streptavidin containing a fluorescent marker or enzymatic activity that can be detected by optical or calorimetric methods), one or more radioisotopes or radionuclides, one or more fluorescent labels, one or more enzymatic labels, and/or one or more chemiluminescent agents. In some embodiments, detectable moieties are attached by spacer molecules.

The disclosure also pertains to immunoconjugates comprising an antibody conjugated to a cytotoxic agent such as a toxin (e.g., an enzymatically active toxin of bacterial, fungal, plant, or animal origin, or fragments thereof), or a radioactive isotope (i.e., a radioconjugate). Suitable cytotoxic agents include, for example, dolastatins and derivatives thereof (e.g. auristatin E, AFP, MMAF, MMAE, MMAD, DMAF, DMAE). For example, the agent is monomethyl auristatin E (MMAE) or monomethyl auristatin D (MMAD). In some embodiments, the agent is an agent selected from the group listed in Table 5. In some embodiments, the agent is a dolastatin. In some embodiments, the agent is an auristatin or derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid or maytansinoid derivative. In some embodiments, the agent is DM1 or DM4. In some embodiments, the agent is a duocarmycin or derivative thereof. In some embodiments, the agent is a calicheamicin or derivative thereof. In some embodiments, the agent is a pyrrolobenzodiazepine. In some embodiments, the agent is a pyrrolobenzodiazepine dimer.

In some embodiments, the agent is linked to the AB using a maleimide caproyl-valine-citrulline linker or a maleimide PEG-valine-citrulline linker. In some embodiments, the agent is linked to the AB using a maleimide caproyl-valine-citrulline linker. In some embodiments, the agent is linked to the AB using a maleimide PEG-valine-citrulline linker In some embodiments, the agent is monomethyl auristatin D (MMAD) linked to the AB using a maleimide PEG-valine-citrulline-para-aminobenzyloxycarbonyl linker, and this linker payload construct is referred to herein as "vc-MMAD." In some embodiments, the agent is monomethyl auristatin E (MMAE) linked to the AB using a maleimide PEG-valine-citrulline-para-aminobenzyloxycarbonyl linker, and this linker payload construct is referred to herein as "vc-MMAE." In some embodiments, the agent is linked to the AB using a maleimide PEG-valine-citrulline linker In some embodiments, the agent is monomethyl auristatin D (MMAD) linked to the AB using a maleimide bis-PEG-valine-citrulline-para-aminobenzyloxycarbonyl linker, and this linker payload construct is referred to herein as "PEG2-vc-MMAD." The structures of vc-MMAD, vc-MMAE, and PEG2-vc-MMAD are shown below:

vc-MMAD:

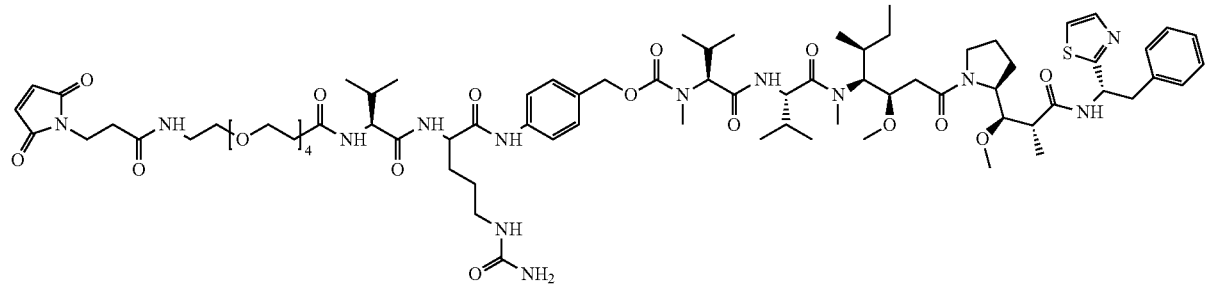

vc-MMAE:

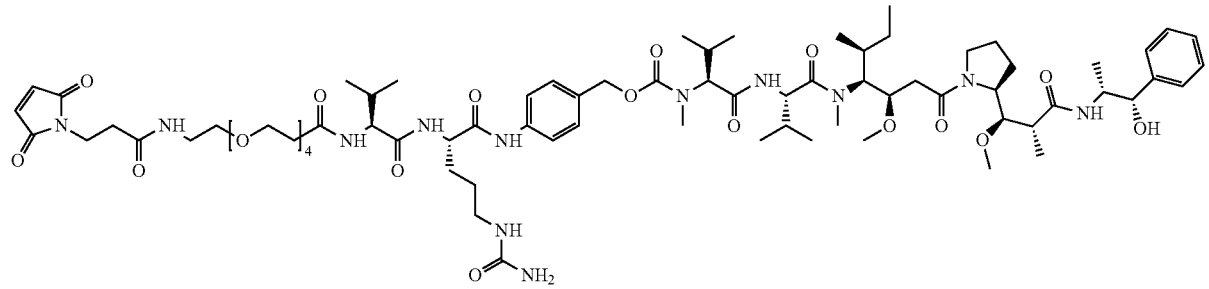

PEG2-vc-MMAD:

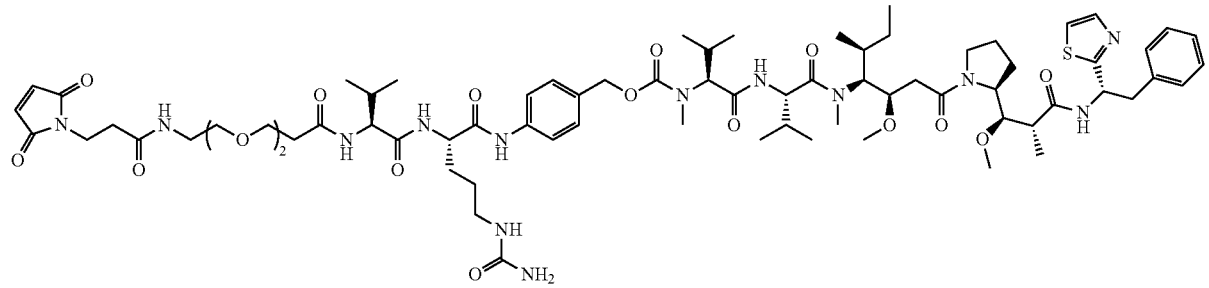

The disclosure also provides conjugated activatable antibodies that include an activatable antibody linked to monomethyl auristatin D (MMAD) payload, wherein the activatable antibody includes an antibody or an antigen binding fragment thereof (AB) that specifically binds to a target, a masking moiety (MM) that inhibits the binding of the AB of the activatable antibody in an uncleaved state to the target, and cleavable moiety (CM) coupled to the AB, and the CM is a polypeptide that functions as a substrate for at least one MMP protease.

In some embodiments, the MMAD-conjugated activatable antibody can be conjugated using any of several methods for attaching agents to ABs: (a) attachment to the carbohydrate moieties of the AB, or (b) attachment to sulfhydryl groups of the AB, or (c) attachment to amino groups of the AB, or (d) attachment to carboxylate groups of the AB.

In some embodiments, the MMAD payload is conjugated to the AB via a linker. In some embodiments, the MMAD payload is conjugated to a cysteine in the AB via a linker. In some embodiments, the MMAD payload is conjugated to a lysine in the AB via a linker. In some embodiments, the MMAD payload is conjugated to another residue of the AB via a linker, such as those residues disclosed herein. In some embodiments, the linker is a thiol-containing linker. In some embodiments, the linker is a cleavable linker. In some embodiments, the linker is a non-cleavable linker. In some embodiments, the linker is selected from the group consisting of the linkers shown in Tables 6 and 7. In some embodiments, the activatable antibody and the MMAD payload are linked via a maleimide caproyl-valine-citrulline linker. In some embodiments, the activatable antibody and the MMAD payload are linked via a maleimide PEG-valine-citrulline linker. In some embodiments, the activatable antibody and the MMAD payload are linked via a maleimide caproyl-valine-citrulline-para-aminobenzyloxycarbonyl linker. In some embodiments, the activatable antibody and the MMAD payload are linked via a maleimide PEG-valine-citrulline-para-aminobenzyloxycarbonyl linker. In some embodiments, the MMAD payload is conjugated to the AB using the partial reduction and conjugation technology disclosed herein.

In some embodiments, the polyethylene glycol (PEG) component of a linker of the present disclosure is formed from 2 ethylene glycol monomers, 3 ethylene glycol monomers, 4 ethylene glycol monomers, 5 ethylene glycol monomers, 6 ethylene glycol monomers, 7 ethylene glycol monomers 8 ethylene glycol monomers, 9 ethylene glycol monomers, or at least 10 ethylene glycol monomers. In some embodiments of the present disclosure, the PEG component is a branched polymer. In some embodiments of the present disclosure, the PEG component is an unbranched polymer. In some embodiments, the PEG polymer component is functionalized with an amino group or derivative thereof, a carboxyl group or derivative thereof, or both an amino group or derivative thereof and a carboxyl group or derivative thereof.

In some embodiments, the PEG component of a linker of the present disclosure is an amino-tetra-ethylene glycol-carboxyl group or derivative thereof. In some embodiments, the PEG component of a linker of the present disclosure is an amino-tri-ethylene glycol-carboxyl group or derivative thereof. In some embodiments, the PEG component of a linker of the present disclosure is an amino-di-ethylene glycol-carboxyl group or derivative thereof. In some embodiments, an amino derivative is the formation of an amide bond between the amino group and a carboxyl group to which it is conjugated. In some embodiments, a carboxyl derivative is the formation of an amide bond between the carboxyl group and an amino group to which it is conjugated. In some embodiments, a carboxyl derivative is the formation of an ester bond between the carboxyl group and an hydroxyl group to which it is conjugated.

Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *momordica charantia* inhibitor, curcin, crotin, *sapaonaria officinalis* inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science 238: 1098 (1987). Carbon-14-labeled 1-isothiocyanatobenzyl-3-methyldiethylene tri-aminepentaacetic acid (MX-DTPA) is an exemplary chelating agent for conjugation of radionucleotide to the antibody. (See WO94/11026).

Table 5 lists some of the exemplary pharmaceutical agents that can be employed in the herein described disclosure but in no way is meant to be an exhaustive list.

TABLE 5

| Exemplary Pharmaceutical Agents for Conjugation |
|---|
| CYTOTOXIC AGENTS |
| Auristatins |
| Auristatin E |
| Monomethyl auristatin D (MMAD) |
| Monomethyl auristatin E (MMAE) |
| Desmethyl auristatin E (DMAE) |
| Auristatin F |
| Monomethyl auristatin F (MMAF) |
| Desmethyl auristatin F (DMAF) |
| Auristatin derivatives, e.g., amides thereof |
| Auristatin tyramine |
| Auristatin quinoline |
| Dolastatins |
| Dolastatin derivatives |
| Dolastatin 16 DmJ |
| Dolastatin 16 Dpv |
| Maytansinoids, e.g. DM-1; DM-4 |
| Maytansinoid derivatives |
| Duocarmycin |
| Duocarmycin derivatives |
| Alpha-amanitin |
| Anthracyclines |
| Doxorubicin |
| Daunorubicin |
| Bryostatins |
| Camptothecin |
| Camptothecin derivatives |
| 7-substituted Camptothecin |
| 10,11-Difluoromethylenedioxycamptothecin |
| Combretastatins |
| Debromoaplysiatoxin |
| Kahalalide-F |
| Discodermolide |
| Ecteinascidins |
| ANTIVIRALS |
| Acyclovir |
| Vira A |
| Symmetrel |
| ANTIFUNGALS |
| Nystatin |
| ADDITIONAL ANTI-NEOPLASTICS |
| Adriamycin |
| Cerubidine |
| Bleomycin |
| Alkeran |
| Velban |
| Oncovin |
| Fluorouracil |
| Methotrexate |
| Thiotepa |
| Bisantrene |
| Novantrone |
| Thioguanine |
| Procarabizine |
| Cytarabine |
| ANTI-BACTERIALS |
| Aminoglycosides |
| Streptomycin |
| Neomycin |
| Kanamycin |
| Amikacin |
| Gentamicin |
| Tobramycin |
| Streptomycin B |
| Spectinomycin |
| Ampicillin |
| Sulfanilamide |
| Polymyxin |
| Chloramphenicol |
| Turbostatin |
| Phenstatins |
| Hydroxyphenstatin |
| Spongistatin 5 |
| Spongistatin 7 |
| Halistatin 1 |
| Halistatin 2 |
| Halistatin 3 |
| Modified Bryostatins |
| Halocomstatins |
| Pyrrolobenzimidazoles (PBI) |
| Cibrostatin6 |
| Doxaliform |
| Anthracyclins analogues |
| Cemadotin analogue (CemCH2-SH) |
| *Pseudomonas* toxin A (PE38) variant |

TABLE 5-continued

Exemplary Pharmaceutical Agents for Conjugation

*Pseudomonas* toxin A (ZZ-PE38) variant
ZJ-101
OSW-1
4-Nitrobenzyloxycarbonyl Derivatives of
O6-Benzylguanine
Topoisomerase inhibitors
Hemiasterlin
Cephalotaxine
Homoharringtonine
Pyrrolobenzodiazepine dimers (PBDs)
Pyrrolobenzodiazepenes
Functionalized pyrrolobenzodiazepenes
Functionalized pyrrolobenzodiazepene
dimers
Calicheamicins
Podophyllotoxins
Taxanes
Vinca alkaloids
CONJUGATABLE DETECTION
REAGENTS Fluorescein and derivatives thereof
Fluorescein isothiocyanate (FITC)
RADIOPHARMACEUTICALS $^{125}$I
$^{131}$I
$^{89}$Zr
$^{111}$In
$^{123}$I
$^{131}$I
$^{99m}$Tc
$^{201}$Tl
$^{133}$Xe
$^{11}$C
$^{62}$Cu
$^{18}$F
$^{68}$Ga
$^{13}$N
$^{15}$O
$^{38}$K
$^{82}$Rb
$^{99m}$Tc (Technetium)
HEAVY METALS Barium
Gold
Platinum
ANTI-MYCOPLASMALS Tylosine
Spectinomycin Those of ordinary skill in the art will recognize that a large variety of possible moieties can be coupled to the resultant antibodies of the disclosure. (See, for example, "Conjugate Vaccines", Contributions to Microbiology and Immunology, J. M. Cruse and R. E. Lewis, Jr (eds), Carger Press, New York, (1989), the entire contents of which are incorporated herein by reference).

Coupling can be accomplished by any chemical reaction that will bind the two molecules so long as the antibody and the other moiety retain their respective activities. This linkage can include many chemical mechanisms, for instance covalent binding, affinity binding, intercalation, coordinate binding and complexation. In some embodiments, the binding is, however, covalent binding. Covalent binding can be achieved either by direct condensation of existing side chains or by the incorporation of external bridging molecules. Many bivalent or polyvalent linking agents are useful in coupling protein molecules, such as the antibodies of the present disclosure, to other molecules. For example, representative coupling agents can include organic compounds such as thioesters, carbodiimides, succinimide esters, diisocyanates, glutaraldehyde, diazobenzenes and hexamethylene diamines. This listing is not intended to be exhaustive of the various classes of coupling agents known in the art but, rather, is exemplary of the more common coupling agents. (See Killen and Lindstrom, Jour. Immun. 133:1335-2549 (1984); Jansen et al., Immunological Reviews 62:185-216 (1982); and Vitetta et al., Science 238:1098 (1987).

In some embodiments, in addition to the compositions and methods provided herein, the conjugated activatable antibody can also be modified for site-specific conjugation through modified amino acid sequences inserted or otherwise included in the activatable antibody sequence. These modified amino acid sequences are designed to allow for controlled placement and/or dosage of the conjugated agent within a conjugated activatable antibody. For example, the activatable antibody can be engineered to include cysteine substitutions at positions on light and heavy chains that provide reactive thiol groups and do not negatively impact protein folding and assembly, nor alter antigen binding. In some embodiments, the activatable antibody can be engineered to include or otherwise introduce one or more non-natural amino acid residues within the activatable antibody to provide suitable sites for conjugation. In some embodiments, the activatable antibody can be engineered to include or otherwise introduce enzymatically activatable peptide sequences within the activatable antibody sequence.

Suitable linkers are described in the literature. (See, for example, Ramakrishnan, S. et al., Cancer Res. 44:201-208 (1984) describing use of MBS (M-maleimidobenzoyl-N-hydroxysuccinimide ester). See also, U.S. Pat. No. 5,030, 719, describing use of halogenated acetyl hydrazide derivative coupled to an antibody by way of an oligopeptide linker. In some embodiments, suitable linkers include: (i) EDC (1-ethyl-3-(3-dimethylamino-propyl) carbodiimide hydrochloride; (ii) SMPT (4-succinimidyloxycarbonyl-alpha-methyl-alpha-(2-pridyl-dithio)-toluene (Pierce Chem. Co., Cat. (21558G); (iii) SPDP (succinimidyl-6 [3-(2-pyridyldithio) propionamido]hexanoate (Pierce Chem. Co., Cat #21651G); (iv) Sulfo-LC-SPDP (sulfosuccinimidyl 6 [3-(2-pyridyldithio)-propianamide] hexanoate (Pierce Chem. Co. Cat. #2165-G); and (v) sulfo-NHS (N-hydroxysulfo-succinimide: Pierce Chem. Co., Cat. #24510) conjugated to EDC. Additional linkers include, but are not limited to, SMCC ((succinimidyl 4-(N-maleimidomethyl)cyclohexane-1-carboxylate), sulfo-SMCC (sulfosuccinimidyl 4-(N-maleimidomethyl)cyclohexane-1-carboxylate), SPDB (N-succinimidyl-4-(2-pyridyldithio) butanoate), or sulfo-SPDB (N-succinimidyl-4-(2-pyridyldithio)-2-sulfo butanoate).

The linkers described above contain components that have different attributes, thus leading to conjugates with differing physio-chemical properties. For example, sulfo-NHS esters of alkyl carboxylates are more stable than sulfo-NHS esters of aromatic carboxylates. NHS-ester containing linkers are less soluble than sulfo-NHS esters. Further, the linker SMPT contains a sterically hindered disulfide bond, and can form conjugates with increased stability. Disulfide linkages, are in general, less stable than other linkages because the disulfide linkage is cleaved in vitro, resulting in less conjugate available. Sulfo-NHS, in particular, can enhance the stability of carbodimide couplings. Carbodimide couplings (such as EDC) when used in conjunction with sulfo-NHS, forms esters that are more resistant to hydrolysis than the carbodimide coupling reaction alone.

In some embodiments, the linkers are cleavable. In some embodiments, the linkers are non-cleavable. In some embodiments, two or more linkers are present. The two or more linkers are all the same, i.e., cleavable or non-cleavable, or the two or more linkers are different, i.e., at least one cleavable and at least one non-cleavable.

The present disclosure utilizes several methods for attaching agents to ABs: (a) attachment to the carbohydrate moieties of the AB, or (b) attachment to sulfhydryl groups of the AB, or (c) attachment to amino groups of the AB, or (d) attachment to carboxylate groups of the AB. According to the disclosure, ABs can be covalently attached to an agent through an intermediate linker having at least two reactive groups, one to react with AB and one to react with the agent. The linker, which may include any compatible organic compound, can be chosen such that the reaction with AB (or agent) does not adversely affect AB reactivity and selectivity. Furthermore, the attachment of linker to agent might not destroy the activity of the agent. Suitable linkers for reaction with oxidized antibodies or oxidized antibody fragments include those containing an amine selected from the group consisting of primary amine, secondary amine, hydrazine, hydrazide, hydroxylamine, phenylhydrazine, semicarbazide and thiosemicarbazide groups. Such reactive functional groups may exist as part of the structure of the linker, or can be introduced by suitable chemical modification of linkers not containing such groups.

According to the present disclosure, suitable linkers for attachment to reduced ABs include those having certain reactive groups capable of reaction with a sulfhydryl group of a reduced antibody or fragment. Such reactive groups include, but are not limited to: reactive haloalkyl groups (including, for example, haloacetyl groups), p-mercuribenzoate groups and groups capable of Michael-type addition reactions (including, for example, maleimides and groups of the type described by Mitra and Lawton, 1979, J. Amer. Chem. Soc. 101: 3097-3110).

According to the present disclosure, suitable linkers for attachment to neither oxidized nor reduced Abs include those having certain functional groups capable of reaction with the primary amino groups present in unmodified lysine residues in the Ab. Such reactive groups include, but are not limited to, NHS carboxylic or carbonic esters, sulfo-NHS carboxylic or carbonic esters, 4-nitrophenyl carboxylic or carbonic esters, pentafluorophenyl carboxylic or carbonic esters, acyl imidazoles, isocyanates, and isothiocyanates.

According to the present disclosure, suitable linkers for attachment to neither oxidized nor reduced Abs include those having certain functional groups capable of reaction with the carboxylic acid groups present in aspartate or glutamate residues in the Ab, which have been activated with suitable reagents. Suitable activating reagents include EDC, with or without added NHS or sulfo-NHS, and other dehydrating agents utilized for carboxamide formation. In these instances, the functional groups present in the suitable linkers would include primary and secondary amines, hydrazines, hydroxylamines, and hydrazides.

The agent can be attached to the linker before or after the linker is attached to the AB. In certain applications it may be desirable to first produce an AB-linker intermediate in which the linker is free of an associated agent. Depending upon the particular application, a specific agent may then be covalently attached to the linker. In some embodiments, the AB is first attached to the MM, CM and associated linkers and then attached to the linker for conjugation purposes.

Branched Linkers: In specific embodiments, branched linkers that have multiple sites for attachment of agents are utilized. For multiple site linkers, a single covalent attachment to an AB would result in an AB-linker intermediate capable of binding an agent at a number of sites. The sites can be aldehyde or sulfhydryl groups or any chemical site to which agents can be attached.

In some embodiments, higher specific activity (or higher ratio of agents to AB) can be achieved by attachment of a single site linker at a plurality of sites on the AB. This plurality of sites can be introduced into the AB by either of two methods. First, one may generate multiple aldehyde groups and/or sulfhydryl groups in the same AB. Second, one may attach to an aldehyde or sulfhydryl of the AB a "branched linker" having multiple functional sites for subsequent attachment to linkers. The functional sites of the branched linker or multiple site linker can be aldehyde or sulfhydryl groups, or can be any chemical site to which linkers can be attached. Still higher specific activities can be obtained by combining these two approaches, that is, attaching multiple site linkers at several sites on the AB.

Cleavable Linkers: Peptide linkers that are susceptible to cleavage by enzymes of the complement system, such as but not limited to u-plasminogen activator, tissue plasminogen activator, trypsin, plasmin, or another enzyme having proteolytic activity can be used in one embodiment of the present disclosure. According to one method of the present disclosure, an agent is attached via a linker susceptible to cleavage by complement. The antibody is selected from a class that can activate complement. The antibody-agent conjugate, thus, activates the complement cascade and releases the agent at the target site. According to another method of the present disclosure, an agent is attached via a linker susceptible to cleavage by enzymes having a proteolytic activity such as a u-plasminogen activator, a tissue plasminogen activator, plasmin, or trypsin. These cleavable linkers are useful in conjugated activatable antibodies that include an extracellular toxin, e.g., by way of non-limiting example, any of the extracellular toxins shown in Table 5.

Non-limiting examples of cleavable linker sequences are provided in Table 6.

TABLE 6

Exemplary Linker Sequences for Conjugation

| Types of Cleavable Sequences | Amino Acid Sequence |
|---|---|
| Plasmin cleavable sequences | |
| Pro-urokinase | PRFKIIGG (SEQ ID NO: 615) |
| | PRFRIIGG (SEQ ID NO: 616) |
| TGFβ | SSRHRRALD (SEQ ID NO: 617) |
| Plasminogen | RKSSIIIRMRDVVL (SEQ ID NO: 618) |
| Staphylokinase | SSSFDKGKYKKGDDA (SEQ ID NO: 619) |
| | SSSFDKGKYKRGDDA (SEQ ID NO: 620) |

TABLE 6-continued

Exemplary Linker Sequences for Conjugation

| Types of Cleavable Sequences | Amino Acid Sequence |
|---|---|
| Factor Xa cleavable sequences | IEGR (SEQ ID NO: 621) |
| | IDGR (SEQ ID NO: 622) |
| | GGSIDGR (SEQ ID NO: 623) |
| MMP cleavable sequences | |
| Gelatinase A | PLGLWA (SEQ ID NO: 624) |
| Collagenase cleavable sequences | |
| Calf skin collagen (α1(I) chain) | GPQGIAGQ (SEQ ID NO: 625) |
| Calf skin collagen (α2(I) chain) | GPQGLLGA (SEQ ID NO: 626) |
| Bovine cartilage collagen (α1 (II) chain) | GIAGQ (SEQ ID NO: 627) |
| Human liver collagen (α1(III) chain) | GPLGIAGI (SEQ ID NO: 628) |
| Human α$_2$M | GPEGLRVG (SEQ ID NO: 629) |
| Human PZP | YGAGLGVV (SEQ ID NO: 630) |
| | AGLGVVER (SEQ ID NO: 631) |
| | AGLGISST (SEQ ID NO: 632) |
| Rat α$_1$M | EPQALAMS (SEQ ID NO: 633) |
| | QALAMSAI (SEQ ID NO: 634) |
| Rat α$_2$M | AAYHLVSQ (SEQ ID NO: 635) |
| | MDAFLESS (SEQ ID NO: 636) |
| Rat α$_1$I$_3$(2J) | ESLPVVAV (SEQ ID NO: 637) |
| Rat α$_1$I$_3$(27J) | SAPAVESE (SEQ ID NO: 638) |
| Human fibroblast collagenase (autolytic cleavages) | DVAQFVLT (SEQ ID NO: 639) |
| | VAQFVLTE (SEQ ID NO: 640) |
| | AQFVLTEG (SEQ ID NO: 641) |
| | PVQPIGPQ (SEQ ID NO: 642) |

In addition, agents can be attached via disulfide bonds (for example, the disulfide bonds on a cysteine molecule) to the AB. Since many tumors naturally release high levels of glutathione (a reducing agent) this can reduce the disulfide bonds with subsequent release of the agent at the site of delivery. In some embodiments, the reducing agent that would modify a CM would also modify the linker of the conjugated activatable antibody.

Spacers and Cleavable Elements: In some embodiments, it may be necessary to construct the linker in such a way as to optimize the spacing between the agent and the AB of the activatable antibody. This can be accomplished by use of a linker of the general structure:

W—(CH$_2$)$_n$-Q wherein
W is either —NH—CH$_2$— or —CH$_2$—;
Q is an amino acid, peptide; and
n is an integer from 0 to 20.

In some embodiments, the linker may comprise a spacer element and a cleavable element. The spacer element serves to position the cleavable element away from the core of the AB such that the cleavable element is more accessible to the enzyme responsible for cleavage. Certain of the branched linkers described above may serve as spacer elements.

Throughout this discussion, it should be understood that the attachment of linker to agent (or of spacer element to cleavable element, or cleavable element to agent) need not be particular mode of attachment or reaction. Any reaction providing a product of suitable stability and biological compatibility is acceptable.

Serum Complement and Selection of Linkers: According to one method of the present disclosure, when release of an agent is desired, an AB that is an antibody of a class that can activate complement is used. The resulting conjugate retains both the ability to bind antigen and activate the complement cascade. Thus, according to this embodiment of the present disclosure, an agent is joined to one end of the cleavable linker or cleavable element and the other end of the linker group is attached to a specific site on the AB. For example, if the agent has an hydroxy group or an amino group, it can be attached to the carboxy terminus of a peptide, amino acid or other suitably chosen linker via an ester or amide bond, respectively. For example, such agents can be attached to the linker peptide via a carbodimide reaction. If the agent contains functional groups that would interfere with attachment to the linker, these interfering functional groups can be blocked before attachment and deblocked once the product conjugate or intermediate is made. The opposite or amino terminus of the linker is then used either directly or after further modification for binding to an AB that is capable of activating complement.

Linkers (or spacer elements of linkers) can be of any desired length, one end of which can be covalently attached to specific sites on the AB of the activatable antibody. The other end of the linker or spacer element can be attached to an amino acid or peptide linker.

Thus when these conjugates bind to antigen in the presence of complement the amide or ester bond that attaches the agent to the linker will be cleaved, resulting in release of the agent in its active form. These conjugates, when administered to a subject, will accomplish delivery and release of the agent at the target site, and are particularly effective for the in vivo delivery of pharmaceutical agents, antibiotics, antimetabolites, antiproliferative agents and the like as presented in but not limited to those in Table 5.

Linkers for Release without Complement Activation: In yet another application of targeted delivery, release of the agent without complement activation is desired since activation of the complement cascade will ultimately lyse the target cell. Hence, this approach is useful when delivery and release of the agent should be accomplished without killing the target cell. Such is the goal when delivery of cell mediators such as hormones, enzymes, corticosteroids, neurotransmitters, genes or enzymes to target cells is desired. These conjugates can be prepared by attaching the agent to an AB that is not capable of activating complement via a linker that is mildly susceptible to cleavage by serum proteases. When this conjugate is administered to an individual, antigen-antibody complexes will form quickly whereas cleavage of the agent will occur slowly, thus resulting in release of the compound at the target site.

Biochemical Cross Linkers: In some embodiments, the activatable antibody can be conjugated to one or more therapeutic agents using certain biochemical cross-linkers. Cross-linking reagents form molecular bridges that tie together functional groups of two different molecules. To link two different proteins in a step-wise manner, hetero-bifunctional cross-linkers can be used that eliminate unwanted homopolymer formation.

Peptidyl linkers cleavable by lysosomal proteases are also useful, for example, Val-Cit, Val-Ala or other dipeptides. In addition, acid-labile linkers cleavable in the low-pH environment of the lysosome can be used, for example: bis-sialyl ether. Other suitable linkers include cathepsin-labile substrates, particularly those that show optimal function at an acidic pH.

Exemplary hetero-bifunctional cross-linkers are referenced in Table 7.

Non-Cleavable Linkers or Direct Attachment: In some embodiments of the disclosure, the conjugate can be designed so that the agent is delivered to the target but not released. This can be accomplished by attaching an agent to an AB either directly or via a non-cleavable linker.

These non-cleavable linkers may include amino acids, peptides, D-amino acids or other organic compounds that can be modified to include functional groups that can subsequently be utilized in attachment to ABs by the methods described herein. A general formula for such an organic linker could be

wherein
W is either —NH—CH$_2$— or —CH$_2$—;
Q is an amino acid, peptide; and
n is an integer from 0 to 20.

Non-Cleavable Conjugates: In some embodiments, a compound can be attached to ABs that do not activate complement. When using ABs that are incapable of complement activation, this attachment can be accomplished using linkers that are susceptible to cleavage by activated complement or using linkers that are not susceptible to cleavage by activated complement.

The antibodies disclosed herein can also be formulated as immunoliposomes. Liposomes containing the antibody are prepared by methods known in the art, such as described in Epstein et al., Proc. Natl. Acad. Sci. USA, 82: 3688 (1985); Hwang et al., Proc. Natl Acad. Sci. USA, 77: 4030 (1980);

TABLE 7

Exemplary Hetero-Bifunctional Cross Linkers
HETERO-BIFUNCTIONAL CROSS-LINKERS

| Linker | Reactive Toward | Advantages and Applications | Spacer Arm Length after cross-linking (Angstroms) |
|---|---|---|---|
| SMPT | Primary amines Sulfhydryls | Greater stability | 11.2 Å |
| SPDP | Primary amines Sulfhydryls | Thiolation Cleavable cross-linking | 6.8 Å |
| LC-SPDP | Primary amines Sulfhydryls | Extended spacer arm | 15.6 Å |
| Sulfo-LC-SPDP | Primary amines Sulfhydryls | Extender spacer arm Water-soluble | 15.6 Å |
| SMCC | Primary amines | Stable maleimide reactive group | 11.6 Å |
|  | Sulfhydryls | Enzyme-antibody conjugation Hapten-carrier protein conjugation |  |
| Sulfo-SMCC | Primary amines | Stable maleimide reactive group | 11.6 Å |
|  | Sulfhydryls | Water-soluble Enzyme-antibody conjugation |  |
| MBS | Primary amines Sulfhydryls | Enzyme-antibody conjugation Hapten-carrier protein conjugation | 9.9 Å |
| Sulfo-MBS | Primary amines Sulfhydryls | Water-soluble | 9.9 Å |
| SIAB | Primary amines Sulfhydryls | Enzyme-antibody conjugation | 10.6 Å |
| Sulfo-SIAB | Primary amines Sulfhydryls | Water-soluble | 10.6 Å |
| SMPB | Primary amines Sulfhydryls | Extended spacer arm Enzyme-antibody conjugation | 14.5 Å |
| Sulfo-SMPB | Primary amines Sulfhydryls | Extended spacer arm Water-soluble | 14.5 Å |
| EDE/Sulfo-NHS | Primary amines Carboxyl groups | Hapten-Carrier conjugation | 0 |
| ABH | Carbohydrates Nonselective | Reacts with sugar groups | 11.9 Å | and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present disclosure can be conjugated to the liposomes as described in Martin et al., J. Biol. Chem., 257: 286-288 (1982) via a disulfide-interchange reaction.

Definitions:

Unless otherwise defined, scientific and technical terms used in connection with the present disclosure shall have the meanings that are commonly understood by those of ordinary skill in the art. The term "a" entity or "an" entity refers to one or more of that entity. For example, a compound refers to one or more compounds. As such, the terms "a", "an", "one or more" and "at least one" can be used interchangeably. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization described herein are those well-known and commonly used in the art. Standard techniques are used for recombinant DNA, oligonucleotide synthesis, and tissue culture and transformation (e.g., electroporation, lipofection). Enzymatic reactions and purification techniques are performed according to manufacturer's specifications or as commonly accomplished in the art or as described herein. The foregoing techniques and procedures are generally performed according to conventional methods well known in the art and as described in various general and more specific references that are cited and discussed throughout the present specification. See e.g., Sambrook et al. Molecular Cloning: A Laboratory Manual (2d ed., Cold Spring Harbor Laboratory Press, Cold Spring Harbor, N.Y. (1989)). The nomenclatures utilized in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

As utilized in accordance with the present disclosure, the following terms, unless otherwise indicated, shall be understood to have the following meanings:

As used herein, the term "antibody" refers to immunoglobulin molecules and immunologically active portions of immunoglobulin (Ig) molecules, i.e., molecules that contain an antigen binding site that specifically binds (immunoreacts with) an antigen. By "specifically bind" or "immunoreacts with" or "immunospecifically bind" is meant that the antibody reacts with one or more antigenic determinants of the desired antigen and does not react with other polypeptides or binds at much lower affinity ($K_d > 10^{-6}$). Antibodies include, but are not limited to, polyclonal, monoclonal, chimeric, domain antibody, single chain, Fab, and F(ab')$_2$ fragments, scFvs, and an Fab expression library.

The basic antibody structural unit is known to comprise a tetramer. Each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. In general, antibody molecules obtained from humans relate to any of the classes IgG, IgM, IgA, IgE and IgD, which differ from one another by the nature of the heavy chain present in the molecule. Certain classes have subclasses as well, such as IgG$_1$, IgG$_2$, and others. Furthermore, in humans, the light chain can be a kappa chain or a lambda chain.

The term "monoclonal antibody" (mAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs contain an antigen binding site capable of immunoreacting with a particular epitope of the antigen characterized by a unique binding affinity for it.

The term "antigen-binding site" or "binding portion" refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains, referred to as "hypervariable regions," are interposed between more conserved flanking stretches known as "framework regions," or "FRs". Thus, the term "FR" refers to amino acid sequences that are naturally found between, and adjacent to, hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs." The assignment of amino acids to each domain is in accordance with the definitions of Kabat Sequences of Proteins of Immunological Interest (National Institutes of Health, Bethesda, Md. (1987 and 1991)), or Chothia & Lesk J. Mol. Biol. 196:901-917 (1987), Chothia et al. Nature 342:878-883 (1989).

As used herein, the term "epitope" includes any protein determinant capable of specific binding to an immunoglobulin, an scFv, or a T-cell receptor. The term "epitope" includes any protein determinant capable of specific binding to an immunoglobulin or T-cell receptor. Epitopic determinants usually consist of chemically active surface groupings of molecules such as amino acids or sugar side chains and usually have specific three dimensional structural characteristics, as well as specific charge characteristics. For example, antibodies can be raised against N-terminal or C-terminal peptides of a polypeptide. An antibody is said to specifically bind an antigen when the dissociation constant is ≤1 µM; in some embodiments, ≤100 nM and in some embodiments, ≤10 nM.

As used herein, the terms "specific binding," "immunological binding," and "immunological binding properties" refer to the non-covalent interactions of the type which occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and geometric parameters that equally influence the rate in both directions. Thus, both the "on rate constant" ($K_{on}$) and the "off rate constant" ($K_{off}$) can be determined by calculation of the concentrations and the actual rates of association and dissociation. (See Nature 361:186-87 (1993)). The ratio of $K_{off}/K_{on}$ enables the cancellation of all parameters not related to affinity, and is equal to the dissociation constant $K_d$. (See, generally, Davies et al. (1990) Annual Rev Biochem 59:439-473). An antibody of the present disclosure is said to specifically bind to the target, when the binding constant ($K_d$) is ≤1 M, in some embodiments ≤100 nM, in some embodiments s 10 nM, and in some embodiments ≤100 pM to about 1 pM, as measured by assays such as radioligand binding assays or similar assays known to those skilled in the art.

The term "isolated polynucleotide" as used herein shall mean a polynucleotide of genomic, cDNA, or synthetic origin or some combination thereof, which by virtue of its origin the "isolated polynucleotide" (1) is not associated with all or a portion of a polynucleotide in which the "isolated polynucleotide" is found in nature, (2) is operably linked to a polynucleotide which it is not linked to in nature, or (3) does not occur in nature as part of a larger sequence. Polynucleotides in accordance with the disclosure include the nucleic acid molecules encoding the heavy chain immunoglobulin molecules shown herein, and nucleic acid molecules encoding the light chain immunoglobulin molecules shown herein.

The term "isolated protein" referred to herein means a protein of cDNA, recombinant RNA, or synthetic origin or some combination thereof, which by virtue of its origin, or source of derivation, the "isolated protein" (1) is not associated with proteins found in nature, (2) is free of other proteins from the same source, e.g., free of murine proteins, (3) is expressed by a cell from a different species, or (4) does not occur in nature.

The term "polypeptide" is used herein as a generic term to refer to native protein, fragments, or analogs of a polypeptide sequence. Hence, native protein fragments, and analogs are species of the polypeptide genus. Polypeptides in accordance with the disclosure comprise the heavy chain immunoglobulin molecules shown herein, and the light chain immunoglobulin molecules shown herein, as well as antibody molecules formed by combinations comprising the heavy chain immunoglobulin molecules with light chain immunoglobulin molecules, such as kappa light chain immunoglobulin molecules, and vice versa, as well as fragments and analogs thereof.

The term "naturally-occurring" as used herein as applied to an object refers to the fact that an object can be found in nature. For example, a polypeptide or polynucleotide sequence that is present in an organism (including viruses) that can be isolated from a source in nature and that has not been intentionally modified by man in the laboratory or otherwise is naturally-occurring.

The term "operably linked" as used herein refers to positions of components so described are in a relationship permitting them to function in their intended manner. A control sequence "operably linked" to a coding sequence is ligated in such a way that expression of the coding sequence is achieved under conditions compatible with the control sequences.

The term "control sequence" as used herein refers to polynucleotide sequences that are necessary to effect the expression and processing of coding sequences to which they are ligated. The nature of such control sequences differs depending upon the host organism in prokaryotes, such control sequences generally include promoter, ribosomal binding site, and transcription termination sequence in eukaryotes, generally, such control sequences include promoters and transcription termination sequence. The term "control sequences" is intended to include, at a minimum, all components whose presence is essential for expression and processing, and can also include additional components whose presence is advantageous, for example, leader sequences and fusion partner sequences. The term "polynucleotide" as referred to herein means nucleotides of at least 10 bases in length, either ribonucleotides or deoxynucleotides or a modified form of either type of nucleotide. The term includes single and double stranded forms of DNA.

The term oligonucleotide referred to herein includes naturally occurring, and modified nucleotides linked together by naturally occurring, and non-naturally occurring oligonucleotide linkages. Oligonucleotides are a polynucleotide subset generally comprising a length of 200 bases or fewer. In some embodiments, oligonucleotides are 10 to 60 bases in length and in some embodiments, 12, 13, 14, 15, 16, 17, 18, 19, or 20 to 40 bases in length. Oligonucleotides are usually single stranded, e.g., for probes, although oligonucleotides may be double stranded, e.g., for use in the construction of a gene mutant. Oligonucleotides of the disclosure are either sense or antisense oligonucleotides.

The term "naturally occurring nucleotides" referred to herein includes deoxyribonucleotides and ribonucleotides. The term "modified nucleotides" referred to herein includes nucleotides with modified or substituted sugar groups and the like. The term "oligonucleotide linkages" referred to herein includes oligonucleotide linkages such as phosphorothioate, phosphorodithioate, phosphoroselerloate, phosphorodiselenoate, phosphoroanilothioate, phoshoraniladate, phosphoronmidate, and the like. See e.g., LaPlanche et al. Nucl. Acids Res. 14:9081 (1986); Stec et al. J. Am. Chem. Soc. 106:6077 (1984), Stein et al. Nucl. Acids Res. 16:3209 (1988), Zon et al. Anti Cancer Drug Design 6:539 (1991); Zon et al. Oligonucleotides and Analogues: A Practical Approach, pp. 87-108 (F. Eckstein, Ed., Oxford University Press, Oxford England (1991)); Stec et al. U.S. Pat. No. 5,151,510; Uhlmann and Peyman Chemical Reviews 90:543 (1990). An oligonucleotide can include a label for detection, if desired.

As used herein, the twenty conventional amino acids and their abbreviations follow conventional usage. See Immunology—A Synthesis (2nd Edition, E. S. Golub and D. R. Green, Eds., Sinauer Associates, Sunderland, Mass. (1991)). Stereoisomers (e.g., D-amino acids) of the twenty conventional amino acids, unnatural amino acids such as α-, α-disubstituted amino acids, N-alkyl amino acids, lactic acid, and other unconventional amino acids may also be suitable components for polypeptides of the present disclosure. Examples of unconventional amino acids include: 4 hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxy-terminal direction, in accordance with standard usage and convention.

Similarly, unless specified otherwise, the left-hand end of single-stranded polynucleotide sequences is the 5' end the left-hand direction of double-stranded polynucleotide sequences is referred to as the 5' direction. The direction of 5' to 3' addition of nascent RNA transcripts is referred to as the transcription direction sequence regions on the DNA strand having the same sequence as the RNA and that are 5' to the 5' end of the RNA transcript are referred to as "upstream sequences", sequence regions on the DNA strand having the same sequence as the RNA and that are 3' to the 3' end of the RNA transcript are referred to as "downstream sequences".

As applied to polypeptides, the term "substantial identity" means that two peptide sequences, when optimally aligned, such as by the programs GAP or BESTFIT using default gap weights, share at least 80 percent sequence identity, in some embodiments, at least 90 percent sequence identity, in some embodiments, at least 95 percent sequence identity, and in some embodiments, at least 99 percent sequence identity.

In some embodiments, residue positions that are not identical differ by conservative amino acid substitutions.

As discussed herein, minor variations in the amino acid sequences of antibodies or immunoglobulin molecules are contemplated as being encompassed by the present disclosure, providing that the variations in the amino acid sequence maintain at least 75%, in some embodiments, at least 80%, 90%, 95%, and in some embodiments, 99%. In particular, conservative amino acid replacements are contemplated. Conservative replacements are those that take place within a family of amino acids that are related in their side chains. Genetically encoded amino acids are generally divided into families: (1) acidic amino acids are aspartate, glutamate; (2) basic amino acids are lysine, arginine, histidine; (3) non-polar amino acids are alanine, valine, leucine, isoleucine, proline, phenylalanine, methionine, tryptophan, and (4) uncharged polar amino acids are glycine, asparagine, glutamine, cysteine, serine, threonine, tyrosine. The hydrophilic amino acids include arginine, asparagine, aspartate, glutamine, glutamate, histidine, lysine, serine, and threonine. The hydrophobic amino acids include alanine, cysteine, isoleucine, leucine, methionine, phenylalanine, proline, tryptophan, tyrosine and valine. Other families of amino acids include (i) serine and threonine, which are the aliphatic-hydroxy family; (ii) asparagine and glutamine, which are the amide containing family; (iii) alanine, valine, leucine and isoleucine, which are the aliphatic family; and (iv) phenylalanine, tryptophan, and tyrosine, which are the aromatic family. For example, it is reasonable to expect that an isolated replacement of a leucine with an isoleucine or valine, an aspartate with a glutamate, a threonine with a serine, or a similar replacement of an amino acid with a structurally related amino acid will not have a major effect on the binding or properties of the resulting molecule, especially if the replacement does not involve an amino acid within a framework site. Whether an amino acid change results in a functional peptide can readily be determined by assaying the specific activity of the polypeptide derivative. Assays are described in detail herein. Fragments or analogs of antibodies or immunoglobulin molecules can be readily prepared by those of ordinary skill in the art. Suitable amino- and carboxy-termini of fragments or analogs occur near boundaries of functional domains. Structural and functional domains can be identified by comparison of the nucleotide and/or amino acid sequence data to public or proprietary sequence databases. In some embodiments, computerized comparison methods are used to identify sequence motifs or predicted protein conformation domains that occur in other proteins of known structure and/or function. Methods to identify protein sequences that fold into a known three-dimensional structure are known. Bowie et al. Science 253:164 (1991). Thus, the foregoing examples demonstrate that those of skill in the art can recognize sequence motifs and structural conformations that can be used to define structural and functional domains in accordance with the disclosure.

Suitable amino acid substitutions are those that: (1) reduce susceptibility to proteolysis, (2) reduce susceptibility to oxidation, (3) alter binding affinity for forming protein complexes, (4) alter binding affinities, and (5) confer or modify other physicochemical or functional properties of such analogs. Analogs can include various muteins of a sequence other than the naturally-occurring peptide sequence. For example, single or multiple amino acid substitutions (for example, conservative amino acid substitutions) can be made in the naturally-occurring sequence (for example, in the portion of the polypeptide outside the domain(s) forming intermolecular contacts. A conservative amino acid substitution should not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et at. Nature 354:105 (1991).

The term "polypeptide fragment" as used herein refers to a polypeptide that has an amino terminal and/or carboxy-terminal deletion and/or one or more internal deletion(s), but where the remaining amino acid sequence is identical to the corresponding positions in the naturally-occurring sequence deduced, for example, from a full length cDNA sequence. Fragments typically are at least 5, 6, 8 or 10 amino acids long, in some embodiments, at least 14 amino acids long, in some embodiments, at least 20 amino acids long, usually at least 50 amino acids long, and in some embodiments, at least 70 amino acids long. The term "analog" as used herein refers to polypeptides that are comprised of a segment of at least 25 amino acids that has substantial identity to a portion of a deduced amino acid sequence and that has specific binding to the target, under suitable binding conditions. Typically, polypeptide analogs comprise a conservative amino acid substitution (or addition or deletion) with respect to the naturally-occurring sequence. Analogs typically are at least 20 amino acids long, in some embodiments, at least 50 amino acids long or longer, and can often be as long as a full-length naturally-occurring polypeptide.

The term "agent" is used herein to denote a chemical compound, a mixture of chemical compounds, a biological macromolecule, or an extract made from biological materials.

As used herein, the terms "label" or "labeled" refers to incorporation of a detectable marker, e.g., by incorporation of a radiolabeled amino acid or attachment to a polypeptide of biotinyl moieties that can be detected by marked avidin (e.g., streptavidin containing a fluorescent marker or enzymatic activity that can be detected by optical or calorimetric methods). In certain situations, the label or marker can also be therapeutic. Various methods of labeling polypeptides and glycoproteins are known in the art and can be used. Examples of labels for polypeptides include, but are not limited to, the following: radioisotopes or radionuclides (e.g., $^{3}H$, $^{14}C$, $^{15}N$, $^{35}S$, $^{90}Y$, $^{99}Tc$, $^{111}In$, $^{125}I$, $^{131}I$), fluorescent labels (e.g., FITC, rhodamine, lanthanide phosphors), enzymatic labels (e.g., horseradish peroxidase, p-galactosidase, luciferase, alkaline phosphatase), chemiluminescent, biotinyl groups, predetermined polypeptide epitopes recognized by a secondary reporter (e.g., leucine zipper pair sequences, binding sites for secondary antibodies, metal binding domains, epitope tags). In some embodiments, labels are attached by spacer arms of various lengths to reduce potential steric hindrance. The term "pharmaceutical agent or drug" as used herein refers to a chemical compound or composition capable of inducing a desired therapeutic effect when properly administered to a patient.

Other chemistry terms herein are used according to conventional usage in the art, as exemplified by The McGraw-Hill Dictionary of Chemical Terms (Parker, S., Ed., McGraw-Hill, San Francisco (1985)).

As used herein, "substantially pure" means an object species is the predominant species present (i.e., on a molar basis it is more abundant than any other individual species in the composition), and in some embodiments, a substantially purified fraction is a composition wherein the object species comprises at least about 50 percent (on a molar basis) of all macromolecular species present.

Generally, a substantially pure composition will comprise more than about 80 percent of all macromolecular species present in the composition, in some embodiments, more than about 85%, 90%, 95%, and 99%. In some embodiments, the object species is purified to essential homogeneity (contaminant species cannot be detected in the composition by conventional detection methods) wherein the composition consists essentially of a single macromolecular species.

The term patient includes human and veterinary subjects.

Antibodies and/or activatable antibodies of the disclosure specifically bind a given target, e.g., a human target protein such as human CD71. Also included in the disclosure are antibodies and/or activatable antibodies that bind to the same epitope as the antibodies and/or activatable antibodies described herein. Also included in the disclosure are antibodies and/or antibodies activatable antibodies that compete with an anti-CD71 antibody and/or an anti-CD71 activatable antibody described herein for binding to CD71, e.g., human CD71. Also included in the disclosure are antibodies and/or antibodies activatable antibodies that cross-compete with an anti-CD71 antibody and/or an anti-CD71 activatable antibody described herein for binding to CD71, e.g., human CD71.

Those skilled in the art will recognize that it is possible to determine, without undue experimentation, if a monoclonal antibody (e.g., a murine monoclonal or humanized antibody) has the same specificity as a monoclonal antibody used in the methods described herein by ascertaining whether the former prevents the latter from binding to the target. If the monoclonal antibody being tested competes with the monoclonal antibody of the disclosure, as shown by a decrease in binding by the monoclonal antibody of the disclosure, then the two monoclonal antibodies bind to the same, or a closely related, epitope. An alternative method for determining whether a monoclonal antibody has the specificity of a monoclonal antibody of the disclosure is to pre-incubate the monoclonal antibody of the disclosure with the target and then add the monoclonal antibody being tested to determine if the monoclonal antibody being tested is inhibited in its ability to bind the target. If the monoclonal antibody being tested is inhibited then, in all likelihood, it has the same, or functionally equivalent, epitopic specificity as the monoclonal antibody of the disclosure.

Multispecific Activatable Antibodies

The disclosure also provides multispecific anti-CD71 activatable antibodies. The multispecific activatable antibodies provided herein are multispecific antibodies that recognize CD71 and at least one or more different antigens or epitopes and that include at least one masking moiety (MM) linked to at least one antigen- or epitope-binding domain of the multispecific antibody such that coupling of the MM reduces the ability of the antigen- or epitope-binding domain to bind its target. In some embodiments, the MM is coupled to the antigen- or epitope-binding domain of the multispecific antibody via a cleavable moiety (CM) that functions as a substrate for at least one protease. The activatable multispecific antibodies provided herein are stable in circulation, activated at intended sites of therapy and/or diagnosis but not in normal, i.e., healthy tissue, and, when activated, exhibit binding to a target that is at least comparable to the corresponding, unmodified multispecific antibody.

In some embodiments, the multispecific activatable antibodies are designed to engage immune effector cells, also referred to herein as immune-effector cell engaging multispecific activatable antibodies. In some embodiments, the multispecific activatable antibodies are designed to engage leukocytes, also referred to herein as leukocyte engaging multispecific activatable antibodies. In some embodiments, the multispecific activatable antibodies are designed to engage T cells, also referred to herein as T-cell engaging multispecific activatable antibodies. In some embodiments, the multispecific activatable antibodies engage a surface antigen on a leukocyte, such as on a T cell, on a natural killer (NK) cell, on a myeloid mononuclear cell, on a macrophage, and/or on another immune effector cell. In some embodiments, the immune effector cell is a leukocyte. In some embodiments, the immune effector cell is a T cell. In some embodiments, the immune effector cell is a NK cell. In some embodiments, the immune effector cell is a mononuclear cell, such as a myeloid mononuclear cell. In some embodiments, the multispecific activatable antibodies are designed to bind or otherwise interact with more than one target and/or more than one epitope, also referred to herein as multi-antigen targeting activatable antibodies. As used herein, the terms "target" and "antigen" are used interchangeably.

In some embodiments, immune effector cell engaging multispecific activatable antibodies of the disclosure include a targeting antibody or antigen-binding fragment thereof that binds CD71 and an immune effector cell engaging antibody or antigen-binding portion thereof, where at least one of the targeting antibody or antigen-binding fragment thereof and/or the immune effector cell engaging antibody or antigen-binding portion thereof is masked. In some embodiments, the immune effector cell engaging antibody or antigen binding fragment thereof includes a first antibody or antigen-binding fragment thereof (AB1) that binds a first, immune effector cell engaging target, where the AB1 is attached to a masking moiety (MM1) such that coupling of the MM1 reduces the ability of the AB1 to bind the first target. In some embodiments, the targeting antibody or antigen-binding fragment thereof includes a second antibody or fragment thereof that includes a second antibody or antigen-binding fragment thereof (AB2) that binds CD71, where the AB2 is attached to a masking moiety (MM2) such that coupling of the MM2 reduces the ability of the AB2 to bind CD71. In some embodiments, the immune effector cell engaging antibody or antigen binding fragment thereof includes a first antibody or antigen-binding fragment thereof (AB1) that binds a first, immune effector cell engaging target, where the AB1 is attached to a masking moiety (MM1) such that coupling of the MM1 reduces the ability of the AB1 to bind the first target, and the targeting antibody or antigen-binding fragment thereof includes a second antibody or fragment thereof that includes a second antibody or antigen-binding fragment thereof (AB2) that binds CD71, where the AB2 is attached to a masking moiety (MM2) such that coupling of the MM2 reduces the ability of the AB2 to bind CD71. In some embodiments, the non-immune effector cell engaging antibody is a cancer targeting antibody. In some embodiments the non-immune cell effector antibody is an IgG. In some embodiments the immune effector cell engaging antibody is a scFv. In some embodiments the CD71-targeting antibody (e.g., non-immune cell effector antibody) is an IgG and the immune effector cell engaging antibody is a scFv. In some embodiments, the immune effector cell is a leukocyte. In some embodiments, the immune effector cell is a T cell. In some embodiments, the immune effector cell is a NK cell. In some embodiments, the immune effector cell is a myeloid mononuclear cell.

In some embodiments, T-cell engaging multispecific activatable antibodies of the disclosure include a CD71-targeting antibody or antigen-binding fragment thereof and a T-cell engaging antibody or antigen-binding portion thereof, where at least one of the CD71-targeting antibody or antigen-binding fragment thereof and/or the T-cell engaging antibody or antigen-binding portion thereof is masked. In some embodiments, the T-cell engaging antibody or antigen binding fragment thereof includes a first antibody or antigen-binding fragment thereof (AB1) that binds a first, T-cell engaging target, where the AB1 is attached to a masking moiety (MM1) such that coupling of the MM1 reduces the ability of the AB1 to bind the first target. In some embodiments, the targeting antibody or antigen-binding fragment thereof includes a second antibody or fragment thereof that includes a second antibody or antigen-binding fragment thereof (AB2) that binds CD71, where the AB2 is attached to a masking moiety (MM2) such that coupling of the MM2 reduces the ability of the AB2 to bind CD71. In some embodiments, the T-cell engaging antibody or antigen binding fragment thereof includes a first antibody or antigen-binding fragment thereof (AB1) that binds a first, T-cell engaging target, where the AB1 is attached to a masking moiety (MM1) such that coupling of the MM1 reduces the ability of the AB1 to bind the first target, and the targeting antibody or antigen-binding fragment thereof includes a second antibody or fragment thereof that includes a second antibody or antigen-binding fragment thereof (AB2) that binds CD71, where the AB2 is attached to a masking moiety (MM2) such that coupling of the MM2 reduces the ability of the AB2 to bind CD71.

In some embodiments of an immune effector cell engaging multispecific activatable antibody, one antigen is CD71, and another antigen is typically a stimulatory or inhibitory receptor present on the surface of a T-cell, natural killer (NK) cell, myeloid mononuclear cell, macrophage, and/or other immune effector cell, such as, but not limited to, B7-H4, BTLA, CD3, CD4, CD8, CD16a, CD25, CD27, CD28, CD32, CD56, CD137, CTLA-4, GITR, HVEM, ICOS, LAG3, NKG2D, OX40, PD-1, TIGIT, TIM3, or VISTA. In some embodiments, the antigen is a stimulatory receptor present on the surface of a T cell or NK cell; examples of such stimulatory receptors include, but are not limited to, CD3, CD27, CD28, CD137 (also referred to as 4-1BB), GITR, HVEM, ICOS, NKG2D, and OX40. In some embodiments, the antigen is an inhibitory receptor present on the surface of a T-cell; examples of such inhibitory receptors include, but are not limited to, BTLA, CTLA-4, LAG3, PD-1, TIGIT, TIM3, and NK-expressed KIRs. The antibody domain conferring specificity to the T-cell surface antigen may also be substituted by a ligand or ligand domain that binds to a T-cell receptor, a NK-cell receptor, a macrophage receptor, and/or other immune effector cell receptor, such as, but not limited to, B7-1, B7-2, B7H3, PDL1, PDL2, or TNFSF9.

In some embodiments, the T-cell engaging multispecific activatable antibody includes an anti-CD3 epsilon (CD3E, also referred to herein as CD3e and CD3) scFv and a targeting antibody or antigen-binding fragment thereof, where at least one of the anti-CD3ε scFv and/or the targeting antibody or antigen-binding portion thereof is masked. In some embodiments, the CD3ε scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the targeting antibody or antigen-binding fragment thereof includes a second antibody or fragment thereof that includes a second antibody or antigen-binding fragment thereof (AB2) that binds CD71, where the AB2 is attached to a masking moiety (MM2) such that coupling of the MM2 reduces the ability of the AB2 to bind CD71. In some embodiments, the CD3ε scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the targeting antibody or antigen-binding fragment thereof includes a second antibody or fragment thereof that includes a second antibody or antigen-binding fragment thereof (AB2) that binds CD71, where the AB2 is attached to a masking moiety (MM2) such that coupling of the MM2 reduces the ability of the AB2 to bind CD71.

In some embodiments, the multi-antigen targeting antibodies and/or multi-antigen targeting activatable antibodies include at least a first antibody or antigen-binding fragment thereof that binds a first target and/or first epitope and a second antibody or antigen-binding fragment thereof that binds a second target and/or a second epitope. In some embodiments, the multi-antigen targeting antibodies and/or multi-antigen targeting activatable antibodies bind two or more different targets. In some embodiments, the multi-antigen targeting antibodies and/or multi-antigen targeting activatable antibodies bind two or more different epitopes on the same target. In some embodiments, the multi-antigen targeting antibodies and/or multi-antigen targeting activatable antibodies bind a combination of two or more different targets and two or more different epitopes on the same target.

In some embodiments, a multispecific activatable antibody comprising an IgG has the IgG variable domains masked. In some embodiments, a multispecific activatable antibody comprising a scFv has the scFv domains masked. In some embodiments, a multispecific activatable antibody has both IgG variable domains and scFv domains, where at least one of the IgG variable domains is coupled to a masking moiety. In some embodiments, a multispecific activatable antibody has both IgG variable domains and scFv domains, where at least one of the scFv domains is coupled to a masking moiety. In some embodiments, a multispecific activatable antibody has both IgG variable domains and scFv domains, where at least one of the IgG variable domains is coupled to a masking moiety and at least one of the scFv domains is coupled to a masking moiety. In some embodiments, a multispecific activatable antibody has both IgG variable domains and scFv domains, where each of the IgG variable domains and the scFv domains is coupled to its own masking moiety. In some embodiments, one antibody domain of a multispecific activatable antibody has specificity for a target antigen and another antibody domain has specificity for a T-cell surface antigen. In some embodiments, one antibody domain of a multispecific activatable antibody has specificity for a target antigen and another antibody domain has specificity for another target antigen. In some embodiments, one antibody domain of a multispecific activatable antibody has specificity for an epitope of a target antigen and another antibody domain has specificity for another epitope of the target antigen.

In a multispecific activatable antibody, a scFv can be fused to the carboxyl terminus of the heavy chain of an IgG activatable antibody, to the carboxyl terminus of the light chain of an IgG activatable antibody, or to the carboxyl termini of both the heavy and light chains of an IgG activatable antibody. In a multispecific activatable antibody, a scFv can be fused to the amino terminus of the heavy chain of an IgG activatable antibody, to the amino terminus of the light chain of an IgG activatable antibody, or to the amino termini of both the heavy and light chains of an IgG activatable antibody. In a multispecific activatable antibody, a scFv can be fused to any combination of one or more carboxyl termini and one or more amino termini of an IgG activatable antibody. In some embodiments, a masking moiety (MM) linked to a cleavable moiety (CM) is attached to and masks an antigen binding domain of the IgG. In some embodiments, a masking moiety (MM) linked to a cleavable moiety (CM) is attached to and masks an antigen binding domain of at least one scFv. In some embodiments, a masking moiety (MM) linked to a cleavable moiety (CM) is attached to and masks an antigen binding domain of an IgG and a masking moiety (MM) linked to a cleavable moiety (CM) is attached to and masks an antigen binding domain of at least one scFv.

The disclosure provides examples of multispecific activatable antibody structures which include, but are not limited to, the following: (VL-CL)₂:(VH-CH1-CH2-CH3-L4-VH*-L3-VL*-L2-CM-L1-MM)₂; (VL-CL)₂:(VH-CH1-CH2-CH3-L4-VL*-L3-VH*-L2-CM-L1-MM)₂; (MM-L1-CM-L2-VL-CL)₂:(VH-CH1-CH2-CH3-L4-VH*-L3-VL*)₂; (MM-L1-CM-L2-VL-CL)₂:(VH-CH1-CH2-CH3-L4-VL*-L3-VH*)₂ (VL-CL)₂:(MM-L1-CM-L2-VL*-L3-VH*-L4-VH-CH1-CH2-CH3)₂; (VL-CL)₂:(MM-L1-CM-L2-VL*-L3-VL*-L4-VL*-H-CH1-CH2-CH3)₂; (MM-L1-CM-L2-VL-CL)₂:(VL*-L3-VH*-L4-VH-CH1-CH2-CH3)₂; (MM-L1-CM-L2-VL-CL)₂:(VH*-L3-VL*-L4-VH-CH1-CH2-CH3)₂; (VL-CL-L4-VH*-L3-VL*-L2-CM-L1-MM)₂:(VH-CH1-CH2-CH3)₂; (VL-CL-L4-VL*-L3-VH*-L2-CM-L1-MM)₂:(VH-CH1-CH2-CH3)₂; (MM-L1-CM-L2-VL*-L3-VH*-L4-VL-CL)₂:(VH-CH1-CH2-CH3)₂; (MM-L1-CM-L2-VH*-L3-VL*-L4-VL-CL)₂:(VH-CH1-CH2-CH3)₂; (VL-CL-L4-VH*-L3-VL*-L2-CM-L1-MM)₂: (MM-L1-CM-L2-VH*-L3-VL*-L4-VH-CH1-CH2-CH3)₂; (VL-CL-L4-VL*-L3-VH*-L2-CM-L1-MM)₂: (MM-L1-CM-L2-VL*-L3-VH*-L4-VH-CH1-CH2-CH3)₂; (VL-CL-L4-VL*-L3-VH*-L2-CM-L1-MM)₂: (VL-CL-L4-VH*-L3-VL*)₂: (MM-L1-CM-L2-VL*-L3-VH*-L4-VH-CH1-CH2-CH3)₂; (VL-CL-L4-VL*-L3-VH*)₂: (MM-L1-CM-L2-VH*-L3-VL*-L4-VH-CH1-CH2-CH3)₂; (VL-CL-L4-VL*-L3-VH*)₂: (MM-L1-CM-L2-VL*-L3-VH*-L4-VH-CH1-CH2-CH3)₂; (VL-CL-L4-VL*-L3-VH*)₂: (MM-L1-CM-L2-VH*-L3-VL*-L4-VH-CH1-CH2-CH3)₂; (VL-CL-L4-VH*-L3-VL*)₂: (MM-L1-CM-L2-VH*-L3-VL*-L4-VH-CH1-CH2-CH3)₂; (VL-CL-L4-VL*-L3-VH*-L2-CM-L1-MM)₂: (VH*-L3-VL*-L4-VH-CH1-CH2-CH3)₂; (VL-CL-L4-VH*-L3-VH*-L2-CM-L1-MM)₂: (VH*-L3-VL*-L4-VH-CH1-CH2-CH3)₂; (VL-CL-L4-VL*-L3-VH*-L2-CM-L1-MM)₂: (VL*-L3-VH*-L4-VH-CH1-CH2-CH3)₂; or (VL-CL-L4-VL*-L3-VH*-L2-CM-L1-MM)₂: (VH*-L3-VL*-L4-VH-CH1-CH2-CH3)₂, wherein: VL and VH represent the light and heavy variable domains of the first specificity, contained in the IgG; VL* and VH* represent the variable domains of the second specificity, contained in the scFv; L1 is a linker peptide connecting the masking moiety (MM) and the cleavable moiety (CM); L2 is a linker peptide connecting the cleavable moiety (CM), and the antibody; L3 is a linker peptide connecting the variable domains of the scFv; L4 is a linker peptide connecting the antibody of the first specificity to the antibody of the second specificity; CL is the light-chain constant domain; and CH1, CH2, CH3 are the heavy chain constant domains. The first and second specificities can be toward any antigen or epitope.

In some embodiments of a T-cell engaging multispecific activatable antibody, one antigen is CD71, and another antigen is typically a stimulatory (also referred to herein as activating) or inhibitory receptor present on the surface of a T-cell, natural killer (NK) cell, myeloid mononuclear cell, macrophage, and/or other immune effector cell, such as, but not limited to, B7-H4, BTLA, CD3, CD4, CD8, CD16a, CD25, CD27, CD28, CD32, CD56, CD137 (also referred to as TNFRSF9), CTLA-4, GITR, HVEM, ICOS, LAG3, NKG2D, OX40, PD-1, TIGIT, TIM3, or VISTA. The antibody domain conferring specificity to the T-cell surface antigen may also be substituted by a ligand or ligand domain that binds to a T-cell receptor, a NK-cell receptor, a macrophage receptor, and/or other immune effector cell receptor.

In some embodiments, the targeting antibody is an anti-CD71 antibody disclosed herein. In some embodiments, the targeting antibody can be in the form an activatable antibody. In some embodiments, the scFv(s) can be in the form of a Pro-scFv (see, e.g., WO 2009/025846, WO 2010/081173).

In some embodiments, the scFv is specific for binding CD3ε, and comprises or is derived from an antibody or fragment thereof that binds CD3ε, e.g., CH2527, FN18, H2C, OKT3, 2C11, UCHT1, or V9. In some embodiments, the scFv is specific for binding CTLA-4 (also referred to herein as CTLA and CTLA4).

In some embodiments, the anti-CTLA-4 scFv includes the amino acid sequence:

```
                                      (SEQ ID NO: 643)
GGGSGGGGSGSGGGSGGGGSGGGEIVLTQSPGTLSLSPGERATLSCRASQ

SVSSSYLAWYQQKPGQAPRLLIYGASSRATGIPDRFSGSGSGTDFTLTIS

RLEPEDFAVYYCQQYGSSPLTFGGGTKVEIKRSGGSTITSYNVYYTKLSS

SGTQVQLVQTGGGVVQPGRSLRLSCAASGSTFSSYAMSWVRQAPGKGLEW

VSAISGSGGSTYYADSVKGRFTISRDNSKNTLYLMNSLRAEDTAVYYCAT

NSLYWYFDLWGRGTLVTVSSAS
```

In some embodiments, the anti-CTLA-4 scFv includes the amino acid sequence that is at least 90%, 91%, 92%, 93%, 94%, 95%, 96%, 97%, 98%, 99% or more identical to the amino acid sequence of SEQ ID NO: 643.

In some embodiments, the anti-CD3ε scFv includes the amino acid sequence:

(SEQ ID NO: 644)
GGGSGGGGSGSGGGSGGGSGGGQVQLQQSGAELARPGASVKMSCKASGY

TFTRYTMHWVKQRPGQGLEWIGYINPSRGYTNYNQKFKDKATLTTDKSSS

TAYMQLSSLTSEDSAVYYCARYYDDHYCLDYWGQGTTLTVSSGGGGSGGG

GSGGGGSQIVLTQSPAIMSASPGEKVTMTCSASSSVSYMNWYQQKSGTSP

KRWIYDTSKLASGVPAHFRGSGSGTSYLLTISGMEAEDAATYYCQQWSSN

PFTFGSGTKEINR

In some embodiments, the anti-CD3ε scFv includes the amino acid sequence that is at least 90%, 91%, 92%, 93%, 94%, 95%, 96%, 97%, 98%, 99% or more identical to the amino acid sequence of SEQ ID NO: 644.

In some embodiments, the scFv is specific for binding one or more T-cells, one or more NK-cells and/or one or more macrophages. In some embodiments, the scFv is specific for binding a target selected from the group consisting of B7-H4, BTLA, CD3, CD4, CD8, CD16a, CD25, CD27, CD28, CD32, CD56, CD137, CTLA-4, GITR, HVEM, ICOS, LAG3, NKG2D, OX40, PD-1, TIGIT, TIM3, or VISTA.

In some embodiments, the multispecific activatable antibody also includes an agent conjugated to the AB. In some embodiments, the agent is a therapeutic agent. In some embodiments, the agent is an antineoplastic agent. In some embodiments, the agent is a toxin or fragment thereof. In some embodiments, the agent is conjugated to the multispecific activatable antibody via a linker. In some embodiments, the agent is conjugated to the AB via a cleavable linker. In some embodiments, the linker is a non-cleavable linker. In some embodiments, the agent is a microtubule inhibitor. In some embodiments, the agent is a nucleic acid damaging agent, such as a DNA alkylator or DNA intercalator, or other DNA damaging agent. In some embodiments, the linker is a cleavable linker. In some embodiments, the agent is an agent selected from the group listed in Table 5. In some embodiments, the agent is a dolastatin. In some embodiments, the agent is an auristatin or derivative thereof. In some embodiments, the agent is auristatin E or a derivative thereof. In some embodiments, the agent is monomethyl auristatin E (MMAE). In some embodiments, the agent is monomethyl auristatin D (MMAD). In some embodiments, the agent is a maytansinoid or maytansinoid derivative. In some embodiments, the agent is DM1 or DM4. In some embodiments, the agent is a duocarmycin or derivative thereof. In some embodiments, the agent is a calicheamicin or derivative thereof. In some embodiments, the agent is a pyrrolobenzodiazepine. In some embodiments, the agent is a pyrrolobenzodiazepine dimer.

In some embodiments, the multispecific activatable antibody also includes a detectable moiety. In some embodiments, the detectable moiety is a diagnostic agent.

In some embodiments, the multispecific activatable antibody naturally contains one or more disulfide bonds. In some embodiments, the multispecific activatable antibody can be engineered to include one or more disulfide bonds.

The disclosure also provides an isolated nucleic acid molecule encoding a multispecific activatable antibody described herein, as well as vectors that include these isolated nucleic acid sequences. The disclosure provides methods of producing a multispecific activatable antibody by culturing a cell under conditions that lead to expression of the activatable antibody, wherein the cell comprises such a nucleic acid molecule. In some embodiments, the cell comprises such a vector.

The disclosure also provides a method of manufacturing multi specific activatable antibodies of the disclosure by (a) culturing a cell comprising a nucleic acid construct that encodes the multispecific activatable antibody under conditions that lead to expression of the multispecific activatable, and (b) recovering the multispecific activatable antibody. Suitable AB, MM, and/or CM include any of the AB, MM, and/or CM disclosed herein.

The disclosure also provides multispecific activatable antibodies and/or multispecific activatable antibody compositions that include at least a first antibody or antigen-binding fragment thereof (AB1) that specifically binds a first target or first epitope and a second antibody or antigen-biding fragment thereof (AB2) that binds a second target or a second epitope, where at least AB1 is coupled or otherwise attached to a masking moiety (MM1), such that coupling of the MM1 reduces the ability of AB1 to bind its target. In some embodiments, the MM1 is coupled to AB1 via a first cleavable moiety (CM1) sequence that includes a substrate for a protease, for example, a protease that is co-localized with the target of AB1 at a treatment site or a diagnostic site in a subject. The multispecific activatable antibodies provided herein are stable in circulation, activated at intended sites of therapy and/or diagnosis but not in normal, i.e., healthy tissue, and, when activated, exhibit binding to the target of AB1 that is at least comparable to the corresponding, unmodified multispecific antibody. Suitable AB, MM, and/or CM include any of the AB, MM, and/or CM disclosed herein.

The disclosure also provides compositions and methods that include a multispecific activatable antibody that includes at least a first antibody or antibody fragment (AB1) that specifically binds a target and a second antibody or antibody fragment (AB2), where at least the first AB in the multispecific activatable antibody is coupled to a masking moiety (MM1) that decreases the ability of AB1 to bind its target. In some embodiments, each AB is coupled to a MM that decreases the ability of its corresponding AB to each target. For example, in bispecific activatable antibody embodiments, AB1 is coupled to a first masking moiety (MM1) that decreases the ability of AB1 to bind its target, and AB2 is coupled to a second masking moiety (MM2) that decreases the ability of AB2 to bind its target. In some embodiments, the multispecific activatable antibody comprises more than two AB regions; in such embodiments, AB1 is coupled to a first masking moiety (MM1) that decreases the ability of AB1 to bind its target, AB2 is coupled to a second masking moiety (MM2) that decreases the ability of AB2 to bind its target, AB3 is coupled to a third masking moiety (MM3) that decreases the ability of AB3 to bind its target, and so on for each AB in the multispecific activatable antibody. Suitable AB, MM, and/or CM include any of the AB, MM, and/or CM disclosed herein.

In some embodiments, the multispecific activatable antibody further includes at least one cleavable moiety (CM) that is a substrate for a protease, where the CM links a MM to an AB. For example, in some embodiments, the multispecific activatable antibody includes at least a first antibody or antibody fragment (AB1) that specifically binds a target and a second antibody or antibody fragment (AB2), where at least the first AB in the multispecific activatable antibody is coupled via a first cleavable moiety (CM1) to a masking moiety (MM1) that decreases the ability of AB1 to bind its target. In some bispecific activatable antibody embodiments, AB1 is coupled via CM1 to MM1, and AB2 is coupled via a second cleavable moiety (CM2) to a second masking moiety (MM2) that decreases the ability of AB2 to bind its target. In some embodiments, the multispecific activatable antibody comprises more than two AB regions; in some of these embodiments, AB1 is coupled via CM1 to MM1, AB2 is coupled via CM2 to MM2, and AB3 is coupled via a third cleavable moiety (CM3) to a third masking moiety (MM3) that decreases the ability of AB3 to bind its target, and so on for each AB in the multispecific activatable antibody. Suitable AB, MM, and/or CM include any of the AB, MM, and/or CM disclosed herein.

Activatable Antibodies Having Non-Binding Steric Moieties or Binding Partners for Non-Binding Steric Moieties The disclosure also provides activatable antibodies that include non-binding steric moieties (NB) or binding partners (BP) for non-binding steric moieties, where the BP recruits or otherwise attracts the NB to the activatable antibody. The activatable antibodies provided herein include, for example, an activatable antibody that includes a non-binding steric moiety (NB), a cleavable linker (CL) and antibody or antibody fragment (AB) that binds a target; an activatable antibody that includes a binding partner for a non-binding steric moiety (BP), a CL and an AB; and an activatable antibody that includes a BP to which an NB has been recruited, a CL and an AB that binds the target. Activatable antibodies in which the NB is covalently linked to the CL and AB of the activatable antibody or is associated by interaction with a BP that is covalently linked to the CL and AB of the activatable antibody are referred to herein as "NB-containing activatable antibodies." By activatable or switchable is meant that the activatable antibody exhibits a first level of binding to a target when the activatable antibody is in an inhibited, masked or uncleaved state (i.e., a first conformation), and a second level of binding to the target when the activatable antibody is in an uninhibited, unmasked and/or cleaved state (i.e., a second conformation, i.e., activated antibody), where the second level of target binding is greater than the first level of target binding. The activatable antibody compositions can exhibit increased bioavailability and more favorable biodistribution compared to conventional antibody therapeutics.

In some embodiments, activatable antibodies provide for reduced toxicity and/or adverse side effects that could otherwise result from binding of the at non-treatment sites and/or non-diagnostic sites if the AB were not masked or otherwise inhibited from binding to such a site.

Anti-CD71 activatable antibodies that include a non-binding steric moiety (NB) can be made using the methods set forth in PCT Publication No. WO 2013/192546, the contents of which are hereby incorporated by reference in their entirety.

Use of Antibodies, Conjugated Antibodies, Activatable Antibodies, and Conjugated Activatable Antibodies It will be appreciated that administration of therapeutic entities in accordance with the disclosure will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences (15th ed, Mack Publishing Company, Easton, Pa. (1975)), particularly Chapter 87 by Blaug, Seymour, therein. These formulations include, for example, powders, pastes, ointments, jellies, waxes, oils, lipids, lipid (cationic or anionic) containing vesicles (such as Lipofectin™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. Any of the foregoing mixtures may be appropriate in treatments and therapies in accordance with the present disclosure, provided that the active ingredient in the formulation is not inactivated by the formulation and the formulation is physiologically compatible and tolerable with the route of administration. See also Baldrick P. "Pharmaceutical excipient development: the need for preclinical guidance." Regul. Toxicol Pharmacol. 32(2):210-8 (2000), Wang W. "Lyophilization and development of solid protein pharmaceuticals." Int. J. Pharm. 203(1-2):1-60 (2000), Charman W N "Lipids, lipophilic drugs, and oral drug delivery-some emerging concepts." J Pharm Sci. 89(8):967-78 (2000), Powell et al. "Compendium of excipients for parenteral formulations" PDA J Pharm Sci Technol. 52:238-311 (1998) and the citations therein for additional information related to formulations, excipients and carriers well known to pharmaceutical chemists.

Therapeutic formulations of the disclosure, which include an anti-CD71 antibody and/or activatable anti-CD71 antibody, such as by way of non-limiting example, an antibody, a conjugated antibody, an activatable antibody and/or a conjugated activatable antibody, are used to prevent, treat or otherwise ameliorate a disease or disorder associated with aberrant target expression and/or activity. For example, therapeutic formulations of the disclosure, which include an antibody, a conjugated antibody, an activatable antibody and/or a conjugated activatable antibody, are used to treat or otherwise ameliorate a cancer or other neoplastic condition, inflammation, an inflammatory disorder, and/or an autoimmune disease. In some embodiments, the cancer is a solid tumor or a hematologic malignancy where the target is expressed. In some embodiments, the cancer is a solid tumor where the target is expressed. In some embodiments, the cancer is a hematologic malignancy where the target is expressed. In some embodiments, the target is expressed on parenchyma (e.g., in cancer, the portion of an organ or tissue that often carries out function(s) of the organ or tissue). In some embodiments, the target is expressed on a cell, tissue, or organ. In some embodiments, the target is expressed on stroma (i.e., the connective supportive framework of a cell, tissue, or organ). In some embodiments, the target is expressed on an osteoblast. In some embodiments, the target is expressed on the endothelium (vasculature). In some embodiments, the target is expressed on a cancer stem cell. In some embodiments, the agent to which the antibody and/or the activatable antibody is conjugated is a microtubule inhibitor. In some embodiments, the agent to which the antibody and/or the activatable antibody is conjugated is a nucleic acid damaging agent.

Efficaciousness of prevention, amelioration or treatment is determined in association with any known method for diagnosing or treating the disease or disorder associated with target expression and/or activity, such as, for example, aberrant target expression and/or activity. Prolonging the survival of a subject or otherwise delaying the progression of the disease or disorder associated with target expression and/or activity, e.g., aberrant target expression and/or activity, in a subject indicates that the antibody, conjugated antibody, activatable antibody and/or conjugated activatable antibody confers a clinical benefit.

An antibody, a conjugated antibody, an activatable antibody and/or a conjugated activatable antibody can be administered in the form of pharmaceutical compositions. Principles and considerations involved in preparing such compositions, as well as guidance in the choice of components are provided, for example, in Remington: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

In some embodiments where antibody fragments are used, the smallest fragment that specifically binds to the binding domain of the target protein is selected. For example, based upon the variable-region sequences of an antibody, peptide molecules can be designed that retain the ability to bind the target protein sequence. Such peptides can be synthesized chemically and/or produced by recombinant DNA technology. (See, e.g., Marasco et al., Proc. Natl. Acad. Sci. USA, 90: 7889-7893 (1993)). The formulation can also contain more than one active compounds as necessary for the particular indication being treated, for example, in some embodiments, those with complementary activities that do not adversely affect each other. In some embodiments, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients can also be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles, and nanocapsules) or in macroemulsions.

The formulations to be used for in vivo administration must be sterile. This is readily accomplished by filtration through sterile filtration membranes.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

In some embodiments, the antibody, the conjugated antibody, activatable antibody and/or conjugated activatable antibody contains a detectable label. An intact antibody, or a fragment thereof (e.g., Fab, scFv, or F(ab)$_2$) is used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the disclosure can be used to detect an analyte mRNA, protein, or genomic DNA in a biological sample in vitro as well as in vivo. For example, in vitro techniques for detection of an analyte mRNA include Northern hybridizations and in situ hybridizations. In vitro techniques for detection of an analyte protein include enzyme linked immunosorbent assays (ELISAs), Western blots, immunoprecipitations, immunochemical staining, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, N.J., 1995, "Immunoassay", E. Diamandis and T. Christopoulus, Academic Press. Inc., San Diego, Calif., 1996; and "Practice and Theory of Enzyme Immunoassays", P. Tijssen, Elsevier Science Publishers, Amsterdam, 1985. Furthermore, in vivo techniques for detection of an analyte protein include introducing into a subject a labeled anti-analyte protein antibody. For example, the antibody can be labeled with a radioactive marker whose presence and location in a subject can be detected by standard imaging techniques.

The antibodies, conjugated antibodies, activatable antibodies and/or conjugated activatable antibodies of the disclosure are also useful in a variety of diagnostic and prophylactic formulations. In one embodiment, an antibody, a conjugated antibody, an activatable antibody and/or a conjugated activatable antibody is administered to patients that are at risk of developing one or more of the aforementioned disorders. A patient's or organ's predisposition to one or more of the aforementioned disorders can be determined using genotypic, serological or biochemical markers.

In some embodiments of the disclosure, an antibody, a conjugated antibody, an activatable antibody and/or a conjugated activatable antibody is administered to human individuals diagnosed with a clinical indication associated with one or more of the aforementioned disorders. Upon diagnosis, an antibody, a conjugated antibody, an activatable antibody and/or a conjugated activatable antibody is administered to mitigate or reverse the effects of the clinical indication.

An antibody, a conjugated antibody, an activatable antibody, and/or a conjugated activatable antibody of the disclosure is also useful in the detection of a target in patient samples and accordingly are useful as diagnostics. For example, the antibodies and/or activatable antibodies, and conjugated versions thereof, of the disclosure are used in in vitro assays, e.g., ELISA, to detect target levels in a patient sample.

In one embodiment, an antibody, a conjugated antibody, an activatable antibody and/or a conjugated activatable antibody of the disclosure is immobilized on a solid support (e.g., the well(s) of a microtiter plate). The immobilized antibody, conjugated antibody, activatable antibody and/or conjugated activatable antibody serves as a capture antibody for any target that may be present in a test sample. Prior to contacting the immobilized antibody and/or activatable antibody, and/or conjugated versions thereof, with a patient sample, the solid support is rinsed and treated with a blocking agent such as milk protein or albumin to prevent nonspecific adsorption of the analyte.

Subsequently the wells are treated with a test sample suspected of containing the antigen, or with a solution containing a standard amount of the antigen. Such a sample is, e.g., a serum sample from a subject suspected of having levels of circulating antigen considered to be diagnostic of a pathology. After rinsing away the test sample or standard, the solid support is treated with a second antibody that is detectably labeled. The labeled second antibody serves as a detecting antibody. The level of detectable label is measured, and the concentration of target antigen in the test sample is determined by comparison with a standard curve developed from the standard samples.

It will be appreciated that based on the results obtained using the antibodies and activatable antibodies of the disclosure, and conjugated versions thereof, in an in vitro diagnostic assay, it is possible to stage a disease in a subject based on expression levels of the target antigen. For a given disease, samples of blood are taken from subjects diagnosed as being at various stages in the progression of the disease, and/or at various points in the therapeutic treatment of the disease. Using a population of samples that provides statistically significant results for each stage of progression or therapy, a range of concentrations of the antigen that may be considered characteristic of each stage is designated.

An antibody, a conjugated antibody, an activatable antibody and/or a conjugated activatable antibody can also be used in diagnostic and/or imaging methods. In some embodiments, such methods are in vitro methods. In some embodiments, such methods are in vivo methods. In some embodiments, such methods are in situ methods. In some embodiments, such methods are ex vivo methods. For example, activatable antibodies having an enzymatically cleavable CM can be used to detect the presence or absence of an enzyme that is capable of cleaving the CM. Such activatable antibodies can be used in diagnostics, which can include in vivo detection (e.g., qualitative or quantitative) of enzyme activity (or, in some embodiments, an environment of increased reduction potential such as that which can provide for reduction of a disulfide bond) through measured accumulation of activated antibodies (i.e., antibodies resulting from cleavage of an activatable antibody) in a given cell or tissue of a given host organism. Such accumulation of activated antibodies indicates not only that the tissue expresses enzymatic activity (or an increased reduction potential depending on the nature of the CM) but also that the tissue expresses target to which the activated antibody binds.

For example, the CM can be selected to be substrate for at least one protease found at the site of a tumor, at the site of a viral or bacterial infection at a biologically confined site (e.g., such as in an abscess, in an organ, and the like), and the like. The AB can be one that binds a target antigen. Using methods as disclosed herein, or when appropriate, methods familiar to one skilled in the art, a detectable label (e.g., a fluorescent label or radioactive label or radiotracer) can be conjugated to an AB or other region of an antibody and/or activatable antibody. Suitable detectable labels are discussed in the context of the above screening methods and additional specific examples are provided below. Using an AB specific to a protein or peptide of the disease state, along with at least one protease whose activity is elevated in the disease tissue of interest, activatable antibodies will exhibit an increased rate of binding to disease tissue relative to tissues where the CM specific enzyme is not present at a detectable level or is present at a lower level than in disease tissue or is inactive (e.g., in zymogen form or in complex with an inhibitor). Since small proteins and peptides are rapidly cleared from the blood by the renal filtration system, and because the enzyme specific for the CM is not present at a detectable level (or is present at lower levels in non-disease tissues or is present in inactive conformation), accumulation of activated antibodies in the disease tissue is enhanced relative to non-disease tissues.

In another example, activatable antibodies can be used to detect the presence or absence of a cleaving agent in a sample. For example, where the activatable antibodies contain a CM susceptible to cleavage by an enzyme, the activatable antibodies can be used to detect (either qualitatively or quantitatively) the presence of an enzyme in the sample. In another example, where the activatable antibodies contain a CM susceptible to cleavage by reducing agent, the activatable antibodies can be used to detect (either qualitatively or quantitatively) the presence of reducing conditions in a sample. To facilitate analysis in these methods, the activatable antibodies can be detectably labeled, and can be bound to a support (e.g., a solid support, such as a slide or bead). The detectable label can be positioned on a portion of the activatable antibody that is not released following cleavage, for example, the detectable label can be a quenched fluorescent label or other label that is not detectable until cleavage has occurred. The assay can be conducted by, for example, contacting the immobilized, detectably labeled activatable antibodies with a sample suspected of containing an enzyme and/or reducing agent for a time sufficient for cleavage to occur, then washing to remove excess sample and contaminants. The presence or absence of the cleaving agent (e.g., enzyme or reducing agent) in the sample is then assessed by a change in detectable signal of the activatable antibodies prior to contacting with the sample e.g., the presence of and/or an increase in detectable signal due to cleavage of the activatable antibody by the cleaving agent in the sample.

Such detection methods can be adapted to also provide for detection of the presence or absence of a target that is capable of binding the AB of the activatable antibodies when cleaved. Thus, the assays can be adapted to assess the presence or absence of a cleaving agent and the presence or absence of a target of interest. The presence or absence of the cleaving agent can be detected by the presence of and/or an increase in detectable label of the activatable antibodies as described above, and the presence or absence of the target can be detected by detection of a target-AB complex e.g., by use of a detectably labeled anti-target antibody.

Activatable antibodies are also useful in in situ imaging for the validation of activatable antibody activation, e.g., by protease cleavage, and binding to a particular target. In situ imaging is a technique that enables localization of proteolytic activity and target in biological samples such as cell cultures or tissue sections. Using this technique, it is possible to confirm both binding to a given target and proteolytic activity based on the presence of a detectable label (e.g., a fluorescent label).

These techniques are useful with any frozen cells or tissue derived from a disease site (e.g. tumor tissue) or healthy tissues. These techniques are also useful with fresh cell or tissue samples.

In these techniques, an activatable antibody is labeled with a detectable label. The detectable label can be a fluorescent dye, (e.g. a fluorophore, Fluorescein Isothiocyanate (FITC), Rhodamine Isothiocyanate (TRITC), an Alexa Fluor® label), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

Detection of the label in a sample that has been incubated with the labeled, activatable antibody indicates that the sample contains the target and contains a protease that is specific for the CM of the activatable antibody. In some embodiments, the presence of the protease can be confirmed using broad spectrum protease inhibitors such as those described herein, and/or by using an agent that is specific for the protease, for example, an antibody such as A11, which is specific for the protease matriptase and inhibits the proteolytic activity of matriptase; see e.g., International Publication Number WO 2010/129609, published 11 Nov. 2010. The same approach of using broad spectrum protease inhibitors such as those described herein, and/or by using a more selective inhibitory agent can be used to identify a protease that is specific for the CM of the activatable antibody. In some embodiments, the presence of the target can be confirmed using an agent that is specific for the target, e.g., another antibody, or the detectable label can be competed with unlabeled target. In some embodiments, unlabeled activatable antibody could be used, with detection by a labeled secondary antibody or more complex detection system.

Similar techniques are also useful for in vivo imaging where detection of the fluorescent signal in a subject, e.g., a mammal, including a human, indicates that the disease site contains the target and contains a protease that is specific for the CM of the activatable antibody.

These techniques are also useful in kits and/or as reagents for the detection, identification or characterization of protease activity in a variety of cells, tissues, and organisms based on the protease-specific CM in the activatable antibody.

The disclosure provides methods of using the antibodies and/or activatable antibodies in a variety of diagnostic and/or prophylactic indications. For example, the disclosure provides methods of detecting presence or absence of a cleaving agent and a target of interest in a subject or a sample by (i) contacting a subject or sample with an activatable antibody, wherein the activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent and the target are present in the subject or sample and wherein no detectable level of activated activatable antibody in the subject or sample indicates that the cleaving agent, the target or both the cleaving agent and the target are absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides methods of detecting presence or absence of a cleaving agent in a subject or a sample by (i) contacting a subject or sample with an activatable antibody in the presence of a target of interest, e.g., the target, wherein the activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent is present in the subject or sample and wherein no detectable level of activated activatable antibody in the subject or sample indicates that the cleaving agent is absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent is present in the subject or sample and wherein no detectable level of activated activatable antibody in the subject or sample indicates that the cleaving agent is absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides methods of detecting presence or absence of a cleaving agent in a subject or a sample by (i) contacting a subject or sample with an activatable antibody, wherein the activatable antibody comprises a masking moiety (MM), a cleavable moiety (CM) that is cleaved by the cleaving agent, e.g., a protease, an antigen binding domain (AB) that specifically binds the target, and a detectable label, wherein the activatable antibody in an uncleaved, non-activated state comprises a structural arrangement from N-terminus to C-terminus as follows: MM-CM-AB or AB-CM-MM; wherein the MM is a peptide that inhibits binding of the AB to the target, and wherein the MM does not have an amino acid sequence of a naturally occurring binding partner of the AB and is not a modified form of a natural binding partner of the AB; wherein, in an uncleaved, non-activated state, the MM interferes with specific binding of the AB to the target, and in a cleaved, activated state the MM does not interfere or compete with specific binding of the AB to the target; and wherein the detectable label is positioned on a portion of the activatable antibody that is released following cleavage of the CM; and (ii) measuring a level of detectable label in the subject or sample, wherein a detectable level of the detectable label in the subject or sample indicates that the cleaving agent is absent and/or not sufficiently present in the subject or sample and wherein no detectable level of the detectable label in the subject or sample indicates that the cleaving agent is present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody and/or conjugated activatable antibody (e.g., an activatable antibody to which a therapeutic agent is conjugated) described herein for use in contacting a subject or biological sample and means for detecting the level of activated activatable antibody and/or conjugated activatable antibody in the subject or biological sample, wherein a detectable level of activated activatable antibody in the subject or biological sample indicates that the cleaving agent and the target are present in the subject or biological sample and wherein no detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample.

The disclosure also provides methods of detecting presence or absence of a cleaving agent in a subject or a sample by (i) contacting a subject or biological sample with an activatable antibody in the presence of the target, and (ii) measuring a level of activated activatable antibody in the subject or biological sample, wherein a detectable level of activated activatable antibody in the subject or biological sample indicates that the cleaving agent is present in the subject or biological sample and wherein no detectable level of activated activatable antibody in the subject or biological sample indicates that the cleaving agent is absent and/or not sufficiently present in the subject or biological sample at a detectable level, such that protease cleavage of the activatable antibody cannot be detected in the subject or biological sample. Such an activatable antibody includes a masking moiety (MM), a cleavable moiety (CM) that is cleaved by the cleaving agent, e.g., a protease, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the detectable label is attached to the masking moiety. In some embodiments, the detectable label is attached to the cleavable moiety N-terminal to the protease cleavage site. In some embodiments, a single antigen binding site of the AB is masked. In some embodiments wherein an antibody of the disclosure has at least two antigen binding sites, at least one antigen binding site is masked and at least one antigen binding site is not masked. In some embodiments all antigen binding sites are masked. In some embodiments, the measuring step includes use of a secondary reagent comprising a detectable label.

The disclosure also provides kits for use in methods of detecting presence or absence of a cleaving agent and the target in a subject or a sample, where the kits include at least an activatable antibody and/or conjugated activatable antibody described herein for use in contacting a subject or biological sample with an activatable antibody in the presence of the target, and measuring a level of activated activatable antibody in the subject or biological sample, wherein a detectable level of activated activatable antibody in the subject or biological sample indicates that the cleaving agent is present in the subject or biological sample and wherein no detectable level of activated activatable antibody in the subject or biological sample indicates that the cleaving agent is absent and/or not sufficiently present in the subject or biological sample at a detectable level, such that protease cleavage of the activatable antibody cannot be detected in the subject or biological sample. Such an activatable antibody includes a masking moiety (MM), a cleavable moiety (CM) that is cleaved by the cleaving agent, e.g., a protease, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the detectable label is attached to the masking moiety. In some embodiments, the detectable label is attached to the cleavable moiety N-terminal to the protease cleavage site. In some embodiments, a single antigen binding site of the AB is masked. In some embodiments wherein an antibody of the disclosure has at least two antigen binding sites, at least one antigen binding site is masked and at least one antigen binding site is not masked. In some embodiments all antigen binding sites are masked. In some embodiments, the measuring step includes use of a secondary reagent comprising a detectable label.

The disclosure also provides kits for use in methods of detecting presence or absence of a cleaving agent in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein the activatable antibody includes a detectable label that is positioned on a portion of the activatable antibody that is released following cleavage of the CM, wherein a detectable level of activated activatable antibody in the subject or biological sample indicates that the cleaving agent is absent and/or not sufficiently present in the subject or biological sample such that the target binding and/or protease cleavage of the activatable antibody cannot be detected in the subject or biological sample, and wherein no detectable level of activated activatable antibody in the subject or biological sample indicates that the cleaving agent is present in the subject or biological sample at a detectable level.

The disclosure provides methods of detecting presence or absence of a cleaving agent and the target in a subject or a sample by (i) contacting a subject or biological sample with an activatable antibody, wherein the activatable antibody includes a detectable label that is positioned on a portion of the activatable antibody that is released following cleavage of the CM and (ii) measuring a level of activated activatable antibody in the subject or biological sample, wherein a detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample, and wherein a reduced detectable level of activated activatable antibody in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%. Such an activatable antibody includes a masking moiety (MM), a cleavable moiety (CM) that is cleaved by the cleaving agent, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein a detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample, and wherein a reduced detectable level of activated activatable antibody in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%.

The disclosure also provides methods of detecting presence or absence of a cleaving agent in a subject or a sample by (i) contacting a subject or biological sample with an activatable antibody, wherein the activatable antibody includes a detectable label that is positioned on a portion of the activatable antibody that is released following cleavage of the CM; and (ii) measuring a level of detectable label in the subject or biological sample, wherein a detectable level of the detectable label in the subject or biological sample indicates that the cleaving agent is absent and/or not sufficiently present in the subject or biological sample at a detectable level, such that protease cleavage of the activatable antibody cannot be detected in the subject or biological sample, and wherein a reduced detectable level of the detectable label in the subject or biological sample indicates that the cleaving agent is present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%. Such an activatable antibody includes a masking moiety (MM), a cleavable moiety (CM) that is cleaved by the cleaving agent, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent of interest in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein the activatable antibody includes a detectable label that is positioned on a portion of the activatable antibody that is released following cleavage of the CM, wherein a detectable level of the detectable label in the subject or biological sample indicates that the cleaving agent, the target, or both the cleaving agent and the target are absent and/or not sufficiently present in the subject or biological sample, such that the target binding and/or protease cleavage of the activatable antibody cannot be detected in the subject or biological sample, and wherein a reduced detectable level of the detectable label in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%.

In some embodiments of these methods and kits, the activatable antibody includes a detectable label. In some embodiments of these methods and kits, the detectable label includes an imaging agent, a contrasting agent, an enzyme, a fluorescent label, a chromophore, a dye, one or more metal ions, or a ligand-based label. In some embodiments of these methods and kits, the imaging agent comprises a radioisotope. In some embodiments of these methods and kits, the radioisotope is indium or technetium. In some embodiments of these methods and kits, the contrasting agent comprises iodine, gadolinium or iron oxide. In some embodiments of these methods and kits, the enzyme comprises horseradish peroxidase, alkaline phosphatase, or β-galactosidase. In some embodiments of these methods and kits, the fluorescent label comprises yellow fluorescent protein (YFP), cyan fluorescent protein (CFP), green fluorescent protein (GFP), modified red fluorescent protein (mRFP), red fluorescent protein tdimer2 (RFP tdimer2), HCRED, or a europium derivative. In some embodiments of these methods and kits, the luminescent label comprises an N-methylacrydium derivative. In some embodiments of these methods, the label comprises an Alexa Fluor® label, such as Alex Fluor® 680 or Alexa Fluor® 750. In some embodiments of these methods and kits, the ligand-based label comprises biotin, avidin, streptavidin or one or more haptens.

In some embodiments of these methods and kits, the subject is a mammal. In some embodiments of these methods and kits, the subject is a human. In some embodiments, the subject is a non-human mammal, such as a non-human primate, companion animal (e.g., cat, dog, horse), farm animal, work animal, or zoo animal. In some embodiments, the subject is a rodent.

In some embodiments of these methods, the method is an in vivo method. In some embodiments of these methods, the method is an in situ method. In some embodiments of these methods, the method is an ex vivo method. In some embodiments of these methods, the method is an in vitro method.

In some embodiments, in situ imaging and/or in vivo imaging are useful in methods to identify which patients to treat. For example, in in situ imaging, the activatable antibodies are used to screen patient samples to identify those patients having the appropriate protease(s) and target(s) at the appropriate location, e.g., at a tumor site.

In some embodiments in situ imaging is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative for either or both of the target (e.g., the target) and the protease that cleaves the substrate in the CM in the activatable antibody being tested using these methods might be identified as suitable candidates for another form of therapy. In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease). In some embodiments, the patient is then administered a therapeutically effective amount of the activatable antibody for which the patient tested positive.

In some embodiments in vivo imaging is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative might be identified as suitable candidates for another form of therapy. In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease). In some embodiments, the patient is then administered a therapeutically effective amount of the activatable antibody for which the patient tested positive.

In some embodiments of the methods and kits, the method or kit is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested in these methods are identified as suitable candidates for treatment with such an activatable antibody comprising such a CM. Likewise, patients that test negative for both of the targets (e.g., the target) and the protease that cleaves the substrate in the CM in the activatable antibody being tested using these methods might be identified as suitable candidates for another form of therapy. In some embodiments, such patients can be tested with other activatable antibodies until a suitable activatable antibody for treatment is identified (e.g., an activatable antibody comprising a CM that is cleaved by the patient at the site of disease). In some embodiments, patients that test negative for either of the target (e.g., the target) are identified as suitable candidates for treatment with such an activatable antibody comprising such a CM. In some embodiments, patients that test negative for either of the target (e.g., the target) are identified as not being suitable candidates for treatment with such an activatable antibody comprising such a CM. In some embodiments, such patients can be tested with other activatable antibodies until a suitable activatable antibody for treatment is identified (e.g., an activatable antibody comprising a CM that is cleaved by the patient at the site of disease). In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

In some embodiments, a method or kit is used to identify or otherwise refine a patient population suitable for treatment with an anti-the target activatable antibody and/or conjugated activatable antibody (e.g., activatable antibody to which a therapeutic agent is conjugated) of the disclosure, followed by treatment by administering that activatable antibody and/or conjugated activatable antibody to a subject in need thereof. For example, patients that test positive for both the targets (e.g., the target) and a protease that cleaves the substrate in the cleavable moiety (CM) of the activatable antibody and/or conjugated activatable antibody being tested in these methods are identified as suitable candidates for treatment with such antibody and/or such a conjugated activatable antibody comprising such a CM, and the patient is then administered a therapeutically effective amount of the activatable antibody and/or conjugated activatable antibody that was tested. Likewise, patients that test negative for either or both of the target (e.g., the target) and the protease that cleaves the substrate in the CM in the activatable antibody being tested using these methods might be identified as suitable candidates for another form of therapy. In some embodiments, such patients can be tested with other antibody and/or conjugated activatable antibody until a suitable antibody and/or conjugated activatable antibody for treatment is identified (e.g., an activatable antibody and/or conjugated activatable antibody comprising a CM that is cleaved by the patient at the site of disease). In some embodiments, the patient is then administered a therapeutically effective amount of the activatable antibody and/or conjugated activatable antibody for which the patient tested positive.

In some embodiments of these methods and kits, the MM is a peptide having a length from about 4 to 40 amino acids. In some embodiments of these methods and kits, the activatable antibody comprises a linker peptide, wherein the linker peptide is positioned between the MM and the CM. In some embodiments of these methods and kits, the activatable antibody comprises a linker peptide, where the linker peptide is positioned between the AB and the CM. In some embodiments of these methods and kits, the activatable antibody comprises a first linker peptide (L1) and a second linker peptide (L2), wherein the first linker peptide is positioned between the MM and the CM and the second linker peptide is positioned between the AB and the CM. In some embodiments of these methods and kits, each of L1 and L2 is a peptide of about 1 to 20 amino acids in length, and wherein each of L1 and L2 need not be the same linker. In some embodiments of these methods and kits, one or both of L1 and L2 comprises a glycine-serine polymer. In some embodiments of these methods and kits, at least one of L1 and L2 comprises an amino acid sequence selected from the group consisting of (GS)n, (GSGGS)n (SEQ ID NO: 339) and (GGGS)n (SEQ ID NO: 340), where n is an integer of at least one. In some embodiments of these methods and kits, at least one of L1 and L2 comprises an amino acid sequence having the formula (GGS)n, where n is an integer of at least one. In some embodiments of these methods and kits, at least one of L1 and L2 comprises an amino acid sequence selected from the group consisting of Gly-Gly-Ser-Gly (SEQ ID NO: 341, Gly-Gly-Ser-Gly-Gly (SEQ ID NO: 342), Gly-Ser-Gly-Ser-Gly (SEQ ID NO: 343, Gly-Ser-Gly-Gly-Gly (SEQ ID NO: 344), Gly-Gly-Gly-Ser-Gly (SEQ ID NO: 345), and Gly-Ser-Ser-Ser-Gly (SEQ ID NO: 346).

In some embodiments of these methods and kits, the AB comprises an antibody or antibody fragment sequence selected from the cross-reactive antibody sequences presented herein. In some embodiments of these methods and kits, the AB comprises a Fab fragment, a scFv or a single chain antibody (scAb).

In some embodiments of these methods and kits, the cleaving agent is a protease that is co-localized in the subject or sample with the target and the CM is a polypeptide that functions as a substrate for the protease, wherein the protease cleaves the CM in the activatable antibody when the activatable antibody is exposed to the protease. In some embodiments of these methods and kits, the CM is a polypeptide of up to 15 amino acids in length. In some embodiments of these methods and kits, the CM is coupled to the N-terminus of the AB. In some embodiments of these methods and kits, the CM is coupled to the C-terminus of the AB. In some embodiments of these methods and kits, the CM is coupled to the N-terminus of a VL chain of the AB.

The antibodies, conjugated antibodies, activatable antibodies and/or conjugated activatable antibodies of the disclosure are used in diagnostic and prophylactic formulations. In one embodiment, an activatable antibody is administered to patients that are at risk of developing one or more of the aforementioned inflammation, inflammatory disorders, cancer or other disorders.

A patient's or organ's predisposition to one or more of the aforementioned disorders can be determined using genotypic, serological or biochemical markers.

In some embodiments of the disclosure, an antibody, a conjugated antibody, an activatable antibody and/or a conjugated activatable antibody is administered to human individuals diagnosed with a clinical indication associated with one or more of the aforementioned disorders. Upon diagnosis, an antibody, a conjugated antibody, an activatable antibody and/or a conjugated activatable antibody is administered to mitigate or reverse the effects of the clinical indication.

Antibodies, conjugated antibodies, activatable antibodies and/or conjugated activatable antibodies of the disclosure are also useful in the detection of the target in patient samples and accordingly are useful as diagnostics. For example, the antibodies, conjugated antibodies, the activatable antibodies and/or conjugated activatable antibodies of the disclosure are used in in vitro assays, e.g., ELISA, to detect target levels in a patient sample.

In one embodiment, an antibody and/or activatable antibody of the disclosure is immobilized on a solid support (e.g., the well(s) of a microtiter plate). The immobilized antibody and/or activatable antibody serves as a capture antibody for any target that may be present in a test sample. Prior to contacting the immobilized antibody and/or activatable antibody with a patient sample, the solid support is rinsed and treated with a blocking agent such as milk protein or albumin to prevent nonspecific adsorption of the analyte.

Subsequently the wells are treated with a test sample suspected of containing the antigen, or with a solution containing a standard amount of the antigen. Such a sample is, e.g., a serum sample from a subject suspected of having levels of circulating antigen considered to be diagnostic of a pathology. After rinsing away the test sample or standard, the solid support is treated with a second antibody that is detectably labeled. The labeled second antibody serves as a detecting antibody. The level of detectable label is measured, and the concentration of target antigen in the test sample is determined by comparison with a standard curve developed from the standard samples.

It will be appreciated that based on the results obtained using the antibodies and/or activatable antibodies of the disclosure in an in vitro diagnostic assay, it is possible to stage a disease in a subject based on expression levels of the Target antigen. For a given disease, samples of blood are taken from subjects diagnosed as being at various stages in the progression of the disease, and/or at various points in the therapeutic treatment of the disease. Using a population of samples that provides statistically significant results for each stage of progression or therapy, a range of concentrations of the antigen that may be considered characteristic of each stage is designated.

Antibodies, conjugated antibodies, activatable antibodies and/or conjugated activatable antibodies can also be used in diagnostic and/or imaging methods. In some embodiments, such methods are in vitro methods. In some embodiments, such methods are in vivo methods. In some embodiments, such methods are in situ methods. In some embodiments, such methods are ex vivo methods. For example, activatable antibodies having an enzymatically cleavable CM can be used to detect the presence or absence of an enzyme that is capable of cleaving the CM. Such activatable antibodies can be used in diagnostics, which can include in vivo detection (e.g., qualitative or quantitative) of enzyme activity (or, in some embodiments, an environment of increased reduction potential such as that which can provide for reduction of a disulfide bond) through measured accumulation of activated antibodies (i.e., antibodies resulting from cleavage of an activatable antibody) in a given cell or tissue of a given host organism. Such accumulation of activated antibodies indicates not only that the tissue expresses enzymatic activity (or an increased reduction potential depending on the nature of the CM) but also that the tissue expresses target to which the activated antibody binds.

For example, the CM can be selected to be a protease substrate for a protease found at the site of a tumor, at the site of a viral or bacterial infection at a biologically confined site (e.g., such as in an abscess, in an organ, and the like), and the like. The AB can be one that binds a target antigen. Using methods familiar to one skilled in the art, a detectable label (e.g., a fluorescent label or radioactive label or radiotracer) can be conjugated to an AB or other region of an activatable antibody. Suitable detectable labels are discussed in the context of the above screening methods and additional specific examples are provided below. Using an AB specific to a protein or peptide of the disease state, along with a protease whose activity is elevated in the disease tissue of interest, activatable antibodies will exhibit an increased rate of binding to disease tissue relative to tissues where the CM specific enzyme is not present at a detectable level or is present at a lower level than in disease tissue or is inactive (e.g., in zymogen form or in complex with an inhibitor). Since small proteins and peptides are rapidly cleared from the blood by the renal filtration system, and because the enzyme specific for the CM is not present at a detectable level (or is present at lower levels in non-disease tissues or is present in inactive conformation), accumulation of activated antibodies in the disease tissue is enhanced relative to non-disease tissues.

In another example, activatable antibodies can be used to detect the presence or absence of a cleaving agent in a sample. For example, where the activatable antibodies contain a CM susceptible to cleavage by an enzyme, the activatable antibodies can be used to detect (either qualitatively or quantitatively) the presence of an enzyme in the sample. In another example, where the activatable antibodies contain a CM susceptible to cleavage by reducing agent, the activatable antibodies can be used to detect (either qualitatively or quantitatively) the presence of reducing conditions in a sample. To facilitate analysis in these methods, the activatable antibodies can be detectably labeled, and can be bound to a support (e.g., a solid support, such as a slide or bead). The detectable label can be positioned on a portion of the activatable antibody that is not released following cleavage, for example, the detectable label can be a quenched fluorescent label or other label that is not detectable until cleavage has occurred. The assay can be conducted by, for example, contacting the immobilized, detectably labeled activatable antibodies with a sample suspected of containing an enzyme and/or reducing agent for a time sufficient for cleavage to occur, then washing to remove excess sample and contaminants. The presence or absence of the cleaving agent (e.g., enzyme or reducing agent) in the sample is then assessed by a change in detectable signal of the activatable antibodies prior to contacting with the sample e.g., the presence of and/or an increase in detectable signal due to cleavage of the activatable antibody by the cleaving agent in the sample.

Such detection methods can be adapted to also provide for detection of the presence or absence of a target that is capable of binding the AB of the activatable antibodies when cleaved. Thus, the assays can be adapted to assess the presence or absence of a cleaving agent and the presence or absence of a target of interest. The presence or absence of the cleaving agent can be detected by the presence of and/or an increase in detectable label of the activatable antibodies as described above, and the presence or absence of the target can be detected by detection of a target-AB complex e.g., by use of a detectably labeled anti-target antibody.

Activatable antibodies are also useful in in situ imaging for the validation of activatable antibody activation, e.g., by protease cleavage, and binding to a particular target. In situ imaging is a technique that enables localization of proteolytic activity and target in biological samples such as cell cultures or tissue sections. Using this technique, it is possible to confirm both binding to a given target and proteolytic activity based on the presence of a detectable label (e.g., a fluorescent label).

These techniques are useful with any frozen cells or tissue derived from a disease site (e.g. tumor tissue) or healthy tissues. These techniques are also useful with fresh cell or tissue samples.

In these techniques, an activatable antibody is labeled with a detectable label. The detectable label can be a fluorescent dye, (e.g. Fluorescein Isothiocyanate (FITC), Rhodamine Isothiocyanate (TRITC), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

Detection of the label in a sample that has been incubated with the labeled, activatable antibody indicates that the sample contains the target and contains a protease that is specific for the CM of the activatable antibody. In some embodiments, the presence of the protease can be confirmed using broad spectrum protease inhibitors such as those described herein, and/or by using an agent that is specific for the protease, for example, an antibody such as A11, which is specific for the protease matriptase and inhibits the proteolytic activity of matriptase; see e.g., International Publication Number WO 2010/129609, published 11 Nov. 2010. The same approach of using broad spectrum protease inhibitors such as those described herein, and/or by using a more selective inhibitory agent can be used to identify a protease or class of proteases specific for the CM of the activatable antibody. In some embodiments, the presence of the target can be confirmed using an agent that is specific for the target, e.g., another antibody, or the detectable label can be competed with unlabeled target. In some embodiments, unlabeled activatable antibody could be used, with detection by a labeled secondary antibody or more complex detection system.

Similar techniques are also useful for in vivo imaging where detection of the fluorescent signal in a subject, e.g., a mammal, including a human, indicates that the disease site contains the target and contains a protease that is specific for the CM of the activatable antibody.

These techniques are also useful in kits and/or as reagents for the detection, identification or characterization of protease activity in a variety of cells, tissues, and organisms based on the protease-specific CM in the activatable antibody.

In some embodiments, in situ imaging and/or in vivo imaging are useful in methods to identify which patients to treat. For example, in in situ imaging, the activatable antibodies are used to screen patient samples to identify those patients having the appropriate protease(s) and target(s) at the appropriate location, e.g., at a tumor site.

In some embodiments in situ imaging is used to identify or otherwise refine a patient population suitable for treatment with an activatable antibody of the disclosure. For example, patients that test positive for both the target and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative for either or both of the target and the protease that cleaves the substrate in the CM in the activatable antibody being tested using these methods are identified as suitable candidates for another form of therapy (i.e., not suitable for treatment with the activatable antibody being tested). In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease).

In some embodiments in vivo imaging is used to identify or otherwise refine a patient population suitable for treatment with an activatable antibody of the disclosure. For example, patients that test positive for both the target and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative are identified as suitable candidates for another form of therapy (i.e., not suitable for treatment with the activatable antibody being tested). In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease).

Pharmaceutical Compositions

The antibodies, conjugated antibodies, activatable antibodies and/or conjugated activatable antibodies of the disclosure (also referred to herein as "active compounds"), and derivatives, fragments, analogs and homologs thereof, can be incorporated into pharmaceutical compositions suitable for administration. Such compositions typically comprise the antibody, the conjugated antibody, activatable antibody and/or conjugated activatable antibody and a pharmaceutically acceptable carrier. As used herein, the term "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Suitable examples of such carriers or diluents include, but are not limited to, water, saline, ringer's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the disclosure is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In some embodiments, it will be desirable to include isotonic agents, for example, sugars, polyalcohols such as manitol, sorbitol, sodium chloride in the composition. Prolonged absorption of the injectable compositions can be brought about by including in the composition an agent that delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser that contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated, each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the particular therapeutic effect to be achieved, and the limitations inherent in the art of compounding such an active compound for the treatment of individuals.

The pharmaceutical compositions can be included in a container, pack, or dispenser together with instructions for administration.

The invention will be further described in the following examples, which do not limit the scope of the invention described in the claims.

EXAMPLES

Example 1

Characterization of Anti-CD71 Antibodies

The studies provided herein were designed to evaluate binding of anti-CD71 antibodies of the disclosure.

The anti-CD71 M21 monoclonal antibody of the present disclosure was obtained using mouse hybridoma technology in accordance with techniques known in the art. Mice were immunized with human CD71 extracellular domain (ECD) and subsequent hybridomas were screened using a cytotoxicity piggyback assay, and cytotoxicity positive clones from this assay were confirmed by ELISA to bind the human CD71 ECD polypeptide and confirmed to bind cell surfaces by FACS. The anti-CD71 M21 monoclonal antibody of the present disclosure includes a heavy chain variable region (VH) of SEQ ID NO: 1, and a light chain variable region (VL) of SEQ ID NO: 2, and was used where described herein as a positive control.

The following humanized anti-CD71 antibodies, which were based on the anti-CD71 mouse monoclonal antibody M21, were tested: Ab21.10 LcB:HcA (VH of SEQ ID NO: 3 and VL of SEQ ID NO: 7), Ab21.11 LcB:HcB (VH of SEQ ID NO: 4 and VL of SEQ ID NO: 7), Ab21.12 LcB:HcC (VH of SEQ ID NO: 5 and VL of SEQ ID NO: 7), and M21 (VH of SEQ ID NO: 1 and VL of SEQ ID NO: 2). Binding of various anti-CD71 antibodies of the disclosure was confirmed by FACS (FIG. 1).

As shown in FIG. 1, all of the humanized anti-CD71 antibodies showed binding to human CD71 that was comparable to the binding demonstrated by the CD71 M21 mouse antibody. Binding of the humanized anti-CD71 antibodies was confirmed on the BxPC3 cell line by FACS. Briefly, BxPC3 cells were labeled with mouse monoclonal Mab21 or huCD71 (Ab21.10, Ab21.11, and Ab21.12) antibody at the indicated concentrations and subsequently detected with an Alexa Fluor 647 labeled goat anti-mouse or anti-human IgG Alexa Fluor 647, respectively.

Example 2

Mask Discovery

The studies provided herein were designed to identify and characterize masking moieties for use in activatable anti-CD71 antibodies of the disclosure.

Anti-CD71 21.12 antibody, comprising a VH of SEQ ID NO: 5 and a VL of SEQ ID NO: 7, was used to screen a random $X_{15}$ peptide library with a total diversity of $6\times10^{10}$, where X is any amino acid, using a method similar to that described in PCT International Publication Number WO 2010/081173, published 15 Jul. 2010. The screening consisted of one round of MACS and five rounds of FACS sorting. The initial MACS sorting was done with protein-A Dynabeads (Invitrogen) and the anti-CD71 21.12 antibody at a concentration of 200 nM. For MACS, approximately $1\times10^{12}$ cells were screened for binding and $1\times10^{7}$ cells were collected. Anti-CD71 21.12 was conjugated with DyLight-488 (ThermoFisher), CD71 binding activity was confirmed and anti-CD71 21.12-488 was used as a fluorescent probe for all FACS rounds. Bacterial cells were stained and positive clones were collected as follows: 20 nM anti-CD71 21.12-488 with $1\times10^{6}$ cells collected in FACS round 1, 5 nM anti-CD71 21.12-488 with $6.2\times10^{4}$ cells collected in FACS round 2 and 5 nM anti-CD71 21.12-488 with $5\times10^{3}$ cells and 1 nM anti-CD71 21.12-488 with $5\times10^{2}$ cells collected in FACS round 3, 1 nM anti-CD71 21.12-488 with $>2\times10^{2}$ cells collected in FACS rounds 4 and 5. The positive population from the second FACS round was verified to inhibit binding of the anti-CD71 21.12-488 antibody to recombinant CD71 protein. Individual peptide clones were identified by sequence analysis from the 5 nM binders from FACS round 3 and the 1 nM binders from FACS rounds 3, 4 and 5.

The sequences of the anti-CD71 masking moieties are listed in Table A.

TABLE A

Anti-CD71 masking moieties (MM)

| MM | Amino Acid Sequence | SEQ ID |
|---|---|---|
| TF01 | QFCPWSYYLIGDCDI | 16 |
| TF02 | NLCTEHSFALDCRSY | 17 |
| TF03 | APMPCTSPGCWLTLR | 18 |
| TF04 | QSACIFPMTNSCTYS | 19 |
| TF05 | ASQFCTANPECNYAG | 20 |
| TF06 | THRCLPMQNFCHNPF | 21 |
| TF07 | ICSFESWHQFSNCNP | 22 |
| TF08 | RYSPACYSTCNSINW | 23 |
| TF09 | NRWCAPMQNYCHHST | 24 |
| TF10 | AHCVQMSNHPYCNHG | 25 |
| TF11 | LSHVCLITPMCNAMQ | 26 |
| TF12 | AWWCAPMQNACQHYQ | 27 |
| TF13 | RSPCAVPMSNSCYTI | 28 |
| TF14 | STRCLPMQNYCHFSD | 29 |
| TF15 | PNCLPMQNAQRCHSP | 30 |
| TF16 | NTAFCTHNPFCNRPT | 31 |
| TF17 | MYSPYCYSMCNNIYP | 32 |
| TF18 | IMRSCTSPGCYLYNT | 33 |
| TF19 | TRCFPMSNNPNCMNY | 34 |
| TF20 | NCGNFYYTMMANCNY | 35 |

TABLE A-continued

| Anti-CD71 masking moieties (MM) | | |
|---|---|---|
| MM | Amino Acid Sequence | SEQ ID |
| TF21 | NPNCWAPMMNSCNAF | 36 |
| TF22 | WNCENVNLYLPACMQ | 37 |
| TF23 | TWCPPMSNHPTCTLK | 38 |
| TF24 | GYPCVPMQNRCAWKS | 39 |
| TF25 | LLSPFCTQMCNPKLQ | 40 |
| TF26 | MSRFCTHNPECNFTY | 41 |
| TF27 | MSTCWTQMTNRCTYN | 42 |
| TF28 | RKSPNCYSMCNYYFN | 43 |
| TF29 | TGQCWAPMQNCTHNK | 44 |
| TF30 | TKMGCSKANLCNGAM | 45 |
| TF31 | AHWCAPMQNRCTNAP | 46 |
| TF32 | ASCPLMSNKPTCRQP | 47 |
| TF33 | DQCWAPMMNNFHCNK | 48 |
| TF34 | EYCEYTRPVPMGCWG | 49 |
| TF35 | GMCPLMSNNPNCNNY | 50 |
| TF36 | GSCPLMSNRPSCHSS | 51 |
| TF37 | HGDCAPMTNRCTNTT | 52 |
| TF38 | KLPCWTLHQNSCTEY | 53 |
| TF39 | LASCAPMQNRCYGLN | 54 |
| TF40 | MDRFGCLQMCNWPKN | 55 |
| TF41 | MMHCAMMQNRCSEYH | 56 |
| TF42 | MRSCHSPMMNQCNHI | 57 |
| TF43 | MTHCLPMQNRCTTYM | 58 |
| TF44 | QSKCWTTMMNGCHIN | 59 |
| TF45 | RECMPMQNNPACHMY | 60 |
| TF46 | RPSPACKIMCNMYQH | 61 |
| TF47 | SNRCWAPMTNMCTYN | 62 |
| TF48 | SPKCFPMENRCNHHT | 63 |
| TF49 | TPFCLPMQNSCKHTS | 64 |
| TF50 | TTHCMPMQNKCNRPN | 65 |
| TF51 | TTSCIMPMTNRCTIH | 66 |
| TF52 | VYSPLCHNMCNPRNT | 67 |
| TF53 | WCNNRYIAPMSNCAS | 68 |
| TF54 | WEYCHNTEFIGCTYK | 69 |
| TF55 | WTSFCTHNIFCNMNG | 70 |
| TF56 | YLRGCYEYNMCNCYY | 71 |
| TF57 | YSCAPMQNHPQCNQT | 72 |
| TF58 | ACVNSNYPFDSNCMY | 73 |

TABLE A-continued

| Anti-CD71 masking moieties (MM) | | |
|---|---|---|
| MM | Amino Acid Sequence | SEQ ID |
| TF59 | ADCQIFAMTNRCMNN | 74 |
| TF60 | AECSPMSNRPQCHIH | 75 |
| TF61 | AISCMPMQNSCYHTY | 76 |
| TF62 | AKCWTEYMNHPECRI | 77 |
| TF63 | ALHVLCYNFCNGPTT | 78 |
| TF64 | AMCVGCSRECCWLGK | 79 |
| TF65 | AQPCAPMQNSCHQSV | 80 |
| TF66 | ARLGCTKFNMCNFYS | 81 |
| TF67 | ASCPLMSNKPQCLKH | 82 |
| TF68 | ASTFCTHNPACAYIP | 83 |
| TF69 | ATCPLMSNRPSCISA | 84 |
| TF70 | ATSMYCYSMCNTNNY | 85 |
| TF71 | AYRCMPMQNSCYSTN | 86 |
| TF72 | AYTGCTANNMCNAAY | 87 |
| TF73 | CASLCKNQPCSSNRN | 88 |
| TF74 | DCPMSYYLPMVNCMH | 89 |
| TF75 | DCWRYLGNMNNWCYL | 90 |
| TF76 | DLTFCTANPFCSREF | 91 |
| TF77 | DNSFCTHNYYCMLNK | 92 |
| TF78 | DSRCWTGHQNRCNTI | 93 |
| TF79 | EACMHSLHWRSWCKV | 94 |
| TF80 | ECENLYKAPMENCLR | 95 |
| TF81 | ECRLRNQPMMSNCSM | 96 |
| TF82 | EHPCMPMENRCYTLN | 97 |
| TF83 | ESVCMPMQNVCTWTT | 98 |
| TF84 | EYCNMIPMTNYCSYN | 99 |
| TF85 | EYLWCELMVSCSRLM | 100 |
| TF86 | FKHFCTHNPECKYNT | 101 |
| TF87 | FPQCSPMQNKCGEGR | 102 |
| TF88 | FRSQYCQSMCNYYNN | 103 |
| TF89 | FRWCAPMQNYCHHST | 104 |
| TF90 | FSCTAMSYAEDCWSW | 105 |
| TF91 | FSQGCFHDNMCNRYQ | 106 |
| TF92 | GCFQLCETCCIHSFD | 107 |
| TF93 | GGHCAPMQNNCYYNS | 108 |
| TF94 | GKYCKMPMVNRCYIM | 109 |
| TF95 | GMYCTRMQNSCAHNN | 110 |
| TF96 | GPFFCTHSPECQFDK | 111 |

TABLE A-continued

Anti-CD71 masking moieties (MM)

| MM | Amino Acid Sequence | SEQ ID |
|---|---|---|
| TF97 | GQCFCSSLFCRPLKP | 112 |
| TF98 | GQYCNLPMVNSCNYL | 113 |
| TF99 | GRSCWTSFMNRCTND | 114 |
| TF100 | GTCSWGSPGGQLCGR | 115 |
| TF101 | GVCLLGLETYLLCFS | 116 |
| TF102 | GWSYCINIYCRIDDN | 117 |
| TF103 | HCANHHPTPMQNCKT | 118 |
| TF104 | HCKEAPWTLYMNCNT | 119 |
| TF105 | HCWWPQNIPMNNCIS | 120 |
| TF106 | HFCQNHWQMVNACTA | 121 |
| TF107 | HGQCMPMQNRCSNSY | 127 |
| TF108 | HISPYCQQMCNKWYN | 123 |
| TF109 | HLMECSYENMCNRYY | 124 |
| TF110 | HMYCAPMQNACTKNT | 125 |
| TF111 | HNCWTMMMNKPYCSN | 126 |
| TF112 | HNYCWAPMQNNCMIE | 127 |
| TF113 | HPPCMPMQNRCVSDH | 128 |
| TF114 | HPVFCTHNPNCHHNY | 129 |
| TF115 | HRGCMPMQNSCSTKN | 130 |
| TF116 | HSSCWAPHTNRCHMG | 131 |
| TF117 | HSTFCTHNRNCNNHS | 132 |
| TF118 | HTCHYNTPMTNCHYS | 133 |
| TF119 | HVSPSCTMMCNSYNF | 134 |
| TF120 | IAAECTKHNMCNNAM | 135 |
| TF121 | ICDSSAAPMTNRCMN | 136 |
| TF122 | INVCMPMQNRCIGQN | 137 |
| TF123 | IPCHGQWNFSNCKYQ | 138 |
| TF124 | IPTCVPMQNHCYHSA | 139 |
| TF125 | IVSKHCTSMCNPWNY | 140 |
| TF126 | IYCPPMSNNIACQNN | 141 |
| TF127 | KCALSNQPLMSNCLM | 142 |
| TF128 | KCHDNNFCRNNMCNC | 143 |
| TF129 | KCSLKHTLPMSNCMA | 144 |
| TF130 | KCTNAFRMPMENCMS | 145 |
| TF131 | KFCQQPQTPMQNCSS | 146 |
| TF132 | KGCYTWTTMMNCIPK | 147 |
| TF133 | KHSPYCFSMCNLQIS | 148 |
| TF134 | KPRCSPMQNMCYNKQ | 149 |

TABLE A-continued

Anti-CD71 masking moieties (MM)

| MM | Amino Acid Sequence | SEQ ID |
|---|---|---|
| TF173 | PECPPMSNNPHCNKL | 188 |
| TF174 | PMCWEFYMMNKCIPY | 189 |
| TF175 | PSCPPMSNQPACNRT | 190 |
| TF176 | PSRCFVPMQNYCHNY | 191 |
| TF177 | PTCREHFAMHNRCHD | 192 |
| TF178 | PTHCAPMQNACTPHI | 193 |
| TF179 | PTNCLPMQNRCKMNH | 194 |
| TF180 | QASFCTHNYNCRTNN | 195 |
| TF181 | QCGFLPTDKFSNCKN | 196 |
| TF182 | QNHCWTTMINGCSWT | 197 |
| TF183 | QQSFCTHSPACIASY | 198 |
| TF184 | QAICWTYMTNGCMNY | 199 |
| TF185 | QSQCAPMQNSCAQKH | 200 |
| TF186 | QSYCYYWTMHCNDRY | 201 |
| TF181 | QWYCSPMQNGCSNDN

TABLE A-continued

Anti-CD71 masking moieties (MM)

| MM | Amino Acid Sequence | SEQ ID |
|---|---|---|
| TF249 | TQMFCTHNPECQINL | 264 |
| TF250 | TRCLPMSNHPRCAMP | 265 |
| TF251 | TRFCAPMQNHCMGHN | 266 |
| TF252 | TRKPCHSPGQCIAMY | 267 |
| TF253 | TTCPMWAPMTNCTKS | 268 |
| TF254 | TTHCSPMQNGCTINR | 269 |
| TF255 | TWSPYCLSMCNLRYP | 270 |
| TF256 | VAFCLEPMTNKCAQV | 271 |
| TF257 | VATWCTVGPACAIKG | 272 |
| TF258 | VCSNTQNFPMMNCNY | 273 |
| TF259 | VGGCYVDDLGCMRMY | 274 |
| TF260 | VHLCAPMQNGCMNTQ | 275 |
| TF261 | VKSPFCFSTCNMRMN | 276 |
| TF262 | VSCSHGSPDGLMCRG | 277 |
| TF263 | VSRECTHLNHCNRLS | 278 |
| TF264 | VTCPLMSNRPACNYH | 279 |
| TF265 | VTSPACQNMCNTYNN | 280 |
| TF266 | VVGCGFWDFGCQRHF | 281 |
| TF267 | VVSPSCFSFCNTHWV | 282 |
| TF268 | VWCPRMSNNPHCASM | 283 |
| TF269 | VYSPLCKSFCNPIYY | 284 |
| TF270 | WGKCSPMQNKCTNNS | 285 |
| TF271 | WRGGCFSPGSCLGLL | 286 |
| TF272 | WSQCQFPMVNQCMVR | 287 |
| TF273 | WTSPNCMSMCNNWIR | 288 |
| TF274 | WWGCVPMSNRCEGGR | 289 |
| TF275 | YGNRCNMINSCMNNY | 290 |
| TF276 | YKAFCTHNYNCISKN | 291 |
| TF277 | YLFPTCIEFCNSSRQ | 292 |
| TF278 | YQCPPMSNHPHCIVT | 293 |
| TF279 | YQYCPPMSNRCAIKA | 294 |
| TF280 | YSAYCNYSNMCNRNS | 295 |

The TF01 and TF02 masks were truncated and alanine scanned to generate families of activatable antibodies with different masking efficiencies:

TABLE B

Truncation and Alanine Scanning of Masking Peptides

| | TF01 | QFCPWSYYLIGDCDI | (SEQ ID NO: 16) |
|---|---|---|---|
| 01 | TF01.01 | QFCaWSYYLIGDCDI | (SEQ ID NO: 297) |
| 02 | TF01.02 | QFCPaSYYLIGDCDI | (SEQ ID NO: 298) |
| 03 | TF01.03 | QFCPWaYYLIGDCDT | (SEQ ID NO: 299) |
| 04 | TF01.04 | QFCPWSaYLIGDCDI | (SEQ ID NO: 300) |
| 05 | TF01.05 | QFCPWSYaLIGDCDI | (SEQ ID NO: 301) |
| 06 | TF01.06 | QFCPWSYYaIGDCDI | (SEQ ID NO: 302) |
| 07 | TF01.07 | QFCPWSYYLaGDCDI | (SEQ ID NO: 303) |
| 08 | TF01.08 | QFCPWSYYLIGaCDI | (SEQ ID NO: 304) |

| | TF02 | NLCTEHSFALDCRSY | (SEQ ID NO: 17) |
|---|---|---|---|
| 09 | TF02.09 | NLCaEHSFALDCRSY | (SEQ ID NO: 305) |
| 10 | TF02.10 | NLCTaHSFALDCRSY | (SEQ ID NO: 306) |
| 11 | TF02.11 | NLCTEaSFALDCRSY | (SEQ ID NO: 307) |
| 12 | TF02.12 | NLCTEHaFALDCRSY | (SEQ ID NO: 308) |
| 13 | TF02.13 | NLCTEHSaALDCRSY | (SEQ ID NO: 309) |
| 14 | TF02.14 | NLCTEHSFAaDCRSY | (SEQ ID NO: 310) |
| 15 | TF02.15 | NLCTEHSFALaCRSY | (SEQ ID NO: 311) |
| 16 | TF02.16 | NLCTEHSEALDCaSY | (SEQ ID NO: 312) |
| 17 | TF02.17 | CTEHSFALDCRSY | (SEQ ID NO: 313) |
| 18 | TF02.18 | CTEHSFALDC | (SEQ ID NO: 314) |

These masking peptides were used to generate anti-CD71 activatable antibodies of the disclosure. The sequences for certain of these anti-CD71 activatable antibodies are shown below in Table C. In some embodiments, these anti-CD71 activatable antibodies include cleavable moiety 2001 (ISSGLLSGRSDNH; SEQ ID NO: 406), cleavable moiety 3001 (AVGLLAPPGGLSGRSDNH; SEQ ID NO: 412), cleavable moiety 2007 (ISSGLLSGRSDIH; SEQ ID NO: 684), cleavable moiety 2008 (ISSGLLSGRSDQH; SEQ ID NO: 685), cleavable moiety 2011 (ISSGLLSGRSDNP; SEQ ID NO: 688), cleavable moiety 2012 (ISSGLLSGRSANP; SEQ ID NO: 689), cleavable moiety 2013 (ISSGLLSGRSANI; SEQ ID NO: 690), cleavable moiety 3007 (AVGLLAPPGGLSGRSDIH; SEQ ID NO: 692), cleavable moiety 3008 (AVGLLAPPGGLSGRSDQH; SEQ ID NO: 693), cleavable moiety 3011 (AVGLLAPPGGLSGRSDNP; SEQ ID NO: 696), cleavable moiety 3012 (AVGLLAPPGGLSGRSANP; SEQ ID NO: 697), or cleavable moiety 3013 (AVGLLAPPGGLSGRSANI; SEQ ID NO: 698), as indicated.

While certain sequences shown below include the spacer sequence of SEQ ID NO: 645, those of ordinary skill in the art appreciate that the activatable anti-CD71 antibodies of the disclosure can include any suitable spacer sequence, such as, for example, a spacer sequence selected from the group consisting of QGQSGQG (SEQ ID NO: 645), QGQSGQ (SEQ ID NO: 424), QGQSG (SEQ ID NO: 646), QGQS (SEQ ID NO: 647), QGQ (SEQ ID NO: 648), QG (SEQ ID NO: 649), GQSGQG (SEQ ID NO: 666), QSGQG (SEQ ID NO: 667), SGQG (SEQ ID NO: 668), GQG (SEQ ID NO: 669), G, or Q. In some embodiments, the activatable anti-CD71 antibodies of the disclosure can have no spacer sequence joined to its N-terminus.

TABLE C

Anti-CD71 Activatable Antibody Sequences

HuCD71_HcC-des
Amino Acid Sequence

TABLE C-continued

Anti-CD71 Activatable Antibody Sequences

QVQLVQSGAEVKKPGASVKMSCKASGYTFTSYWMHWVRQAPGQGLEWIGAIYPGNSETGYAQKFQGRATL
TADTSTSTAYMELSSLRSEDTAVYYCTRENWDPGFAFWGQGTLITVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPG (SEQ ID NO: 699)

HuCD71_HcC-des
Nucleotide sequence
CAGGTGCAGCTGGTGCAGTCTGGCGCCGAAGTGAAGAAACCTGGCGCCTCCGTGAAGATGTCCTGCAAGG
CCTCCGGCTACACCTTCACCAGCTACTGGATGCACTGGGTGCGACAGGCTCCAGGCCAGGGCCTCGAATG
GATCGGCGCCATCTACCCCGGCAACTCCGAGACAGGCTACGCCCAGAAGTTCCAGGGCAGAGCCACCCTG
ACCGCCGACACCTCCACCTCCACCGCCTACATGGAACTGTCCAGCCTGCGGAGCGAGGACACCGCCGTGT
ACTACTGCACCAGAGAGAACTGGGACCCCGGCTTCGCCTTCTGGGGCCAGGGCACCCTGATCACCGTGTC
CTCCGCCAGCACCAAGGGCCCCTCCGTGTTCCCTCTGGCCCCTTCCAGCAAGTCCACCTCTGGCGGCACA
GCTGCCCTGGGCTGCCTGGTGAAAGACTACTTCCCCGAGCCCGTGACCGTGTCCTGGAACTCTGGCGCCC
TGACCAGCGGAGTGCACACCTTCCCTGCCGTGCTGCAGTCCTCCGGCCTGTACTCCCTGTCCTCCGTGGT
GACAGTGCCCTCCTCCAGCCTGGGCACCCAGACCTACATCTGCAACGTGAACCACAAGCCCTCCAACACC
AAGGTGGACAAGAAGGTGGAACCCAAGTCCTGCGACAAGACCCACACCTGTCCTCCCTGCCCTGCCCCTG
AACTGCTGGGCGGACCTTCCGTGTTTCTGTTCCCCCCALAGCCCAAGGACACCCTGATGATCTCCCGGAC
CCCCGAAGTGACCTGCGTGGTGGTGGACGTGTCCCACGAGGACCCTGAAGTGAAGTTCAATTGGTACGTG
GACGGCGTGGAAGTGCACAACGCCAAGACCAAGCCCAGAGAGGAACAGTACAACTCCACCTACCGGGTGG
TGTCCGTGCTGACCGTGCTGCACCAGGACTGGCTGAACGGCAAAGAGTACAAGTGCAAGGTGTCCAACAA
GGCCCTGCCTGCCCCCATCGAAAAGACCATCTCCAAGGCCAAGGGCCAGCCCCGCGAGCCCCAGGTGTAC
ACACTGCCACCTAGCCGGGAAGAGATGACCAAGAACCAGGTGTCCCTGACCTGTCTGGTGAAAGGCTTCT
ACCCCTCCGATATCGCCGTGGAATGGGAGAGCAACGGCCAGCCCGAGAACAACTACAAGACCACCCCACC
TGTGCTGGACTCCGACGGCTCATTCTTCCTGTACTCCAAGCTGACCGTGGACAAGTCCCGGTGGCAGCAG
GGCAACGTGTTCTCCTGCAGCGTGATGCACGAGGCCCTGCACAACCACTACACCCAGAAGTCCCTGTCCC
TGAGCCCCGGC (SEQ ID NO: 700)

HuCD71_HcC
Amino Acid Sequence
QVQLVQSGAEVKKPGASVKMSCKASGYTFTSYWMHWVRQAPGQGLEWIGAIYPGNSETGYAQKFQGRATL
TADTSTSTAYMELSSLRSEDTAVYYCTRENWDPGFAFWGQGTLITVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK (SEQ ID NO: 325)

HuCD71_HcC
Nucleotide sequence
CAGGTGCAGCTGGTGCAGTCTGGCGCCGAAGTGAAGAAACCTGGCGCCTCCGTGAAGATGTCCTGCAAGG
CCTCCGGCTACACCTTCACCAGCTACTGGATGCACTGGGTGCGACAGGCTCCAGGCCAGGGCCTCGAATG
GATCGGCGCCATCTACCCCGGCAACTCCGAGACAGGCTACGCCCAGAAGTTCCAGGGCAGAGCCACCCTG
ACCGCCGACACCTCCACCTCCACCGCCTACATGGAACTGTCCAGCCTGCGGAGCGAGGACACCGCCGTGT
ACTACTGCACCAGAGAGAACTGGGACCCCGGCTTCGCCTTCTGGGGCCAGGGCACCCTGATCACCGTGTC
CTCCGCCAGCACCAAGGGCCCCTCCGTGTTCCCTCTGGCCCCTTCCAGCAAGTCCACCTCTGGCGGCACA
GCTGCCCTGGGCTGCCTGGTGAAAGACTACTTCCCCGAGCCCGTGACCGTGTCCTGGAACTCTGGCGCCC
TGACCAGCGGAGTGCACACCTTCCCTGCCGTGCTGCAGTCCTCCGGCCTGTACTCCCTGTCCTCCGTGGT
GACAGTGCCCTCCTCCAGCCTGGGCACCCAGACCTACATCTGCAACGTGAACCACAAGCCCTCCAACACC
AAGGTGGACAAGAAGGTGGAACCCAAGTCCTGCGACAAGACCCACACCTGTCCTCCCTGCCCTGCCCCTG
AACTGCTGGGCGGACCTTCCGTGTTTCTGTTCCCCCCAAAGCCCAAGGACACCCTGATGATCTCCCGGAC
CCCCGAAGTGACCTGCGTGGTGGTGGACGTGTCCCACGAGGACCCTGAAGTGAAGTTCAATTGGTACGTG
GACGGCGTGGAAGTGCACAACGCCAAGACCAAGCCCAGAGAGGAACAGTACAACTCCACCTACCGGGTGG
TGTCCGTGCTGACCGTGCTGCACCAGGACTGGCTGAACGGCAAAGAGTACAAGTGCAAGGTGTCCAACAA
GGCCCTGCCTGCCCCCATCGAAAAGACCATCTCCAAGGCCAAGGGCCAGCCCCGCGAGCCCCAGGTGTAC
ACACTGCCACCTAGCCGGGAAGAGATGACCAAGAACCAGGTGTCCCTGACCTGTCTGGTGAAAGGCTTCT
ACCCCTCCGATATCGCCGTGGAATGGGAGAGCAACGGCCAGCCCGAGAACAACTACAAGACCACCCCACC
TGTGCTGGACTCCGACGGCTCATTCTTCCTGTACTCCAAGCTGACCGTGGACAAGTCCCGGTGGCAGCAG
GGCAACGTGTTCTCCTGCAGCGTGATGCACGAGGCCCTGCACAACCACTACACCCAGAAGTCCCTTCCC
TGAGCCCCGGCAAG (SEQ ID NO: 326)

HUCD71_LcG
Amino Acid Sequence
DIQMTQSPSSLSASVGDRVTITCSASSSVYYMYWFQQKPGKAPKLWIYSTSNLASGVPSRFSGSGSGTDY
TLTISSMQPEDFATYYCQQRRNYPYTFGQGTKLEIKRTVAAPSVFIFPPSDEQLKSGTASVVCLNNNFYP
REAKVQWKVDNALQSGNSQESVTEQDSKDSTYSLSSTLTLSKADYEKHKVYACEVTHQGLSSPVTKSFNR
GEC (SEQ ID NO: 323)

HuCD71_LcB
Nucleotide sequence
GACATCCAGATGACCCAGTCCCCATCCAGCCTGTCCGCCTCCGTGGGCGACACACTGACAATCACCTGTT
CCGCCAGCTCCTCCGTGTACTACATGTACTGGTTCCAGCAGAAGCCCGGCAAGGCCCCCAAGCTGTGGAT
CTACTCCACCTCCAACCTGGCCTCCGGCGTGCCCTCCAGATTCTCCGGCTCTGGCTCCGGCACCGACTAC
ACCCTGACCATCTCCAGCATGCAGCCCGAGGACTTCGCCACCTACTACTGCCAGCAGCGGCGGAACTACC
CCTACACCTTCGGCCAGGGCACCAAGCTGGAAATCAAGCGGACCGTGGCCGCTCCCAGCGTGTTCATCTT TABLE C-continued Anti-CD71 Activatable Antibody Sequences CCCACCCTCCGACGAGCAGCTGAAGTCCGGCACCGCCAGCGTCGTGTGCCTGCTGAACAACTTCTACCCC
CGCGAGGCCAAGGTGCAGTGGAAGGTGGACAACGCCCTGCAGTCCGGCAACTCCCAGGAATCCGTCACCG
AGCAGGACTCCAAGGACAGCACCTACTCCCTGTCCTCCACCCTGACCCTGTCCAAGGCCGACTACGAGAA
GCACAAGGTGTACGCCTGCGAAGTGACCCACCAGGGCCTGTCCAGCCCCGTGACCAAGTCCTTCAACCGC
GGCGAGTGC] (SEQ ID NO: 324)

[spacer (SEQ ID NO: 645)][huCD71Lc_TF01_2001 (SEQ ID NO: 650)]
Amino Acid Sequence
[QGQSGQG][QFCPWSYYLIGDCDIGGGSSGGSISSGLLSGRSDNHGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACETHQGLSSPVTKSFNRGEC] (SEQ ID NO:
327)

[spacer (SEQ ID NO: 662)][huCD71Lc_TF01_2001 (SEQ ID NO: 651)]
Nucleotide Sequence
[CAGGGCCAGTCCGGCCAGGGA][CAGTTCTGCCCTTGGTCCTACTACCTGATCGGCGACTGCGACATCG
GCGGAGGCTCCTCCGGCGGCTCCATCTCCTCGGCCTGCTGTCCGGCAGATCCGACAACCACGGCGGTGG
CAGCGACATCCAGATGACCCAGTCCCCATCCAGCCTGTCCGCCTCCGTGGGCGACAGAGTGACAATCACC
TGTTCCGCCAGCTCCTCCGTGTACTACATGTACTGGTTCCAGCAGAAGCCCGGCAAGGCCCCCAAGCTGT
GGATCTACTCCACCTCCAACCTGGCCTCCGGCGTGCCCTCCAGATTCTCCGGCTCTGGCTCCGGCACCGA
CTACACCCTGACCATCTCCAGCATGCAGCCCGAGCACTTCGCCACCTACTACTGCCAGCAGCGGCGGAAC
TACCCCTACACCTTCGGCCAGGGCACCAAGCTGGAAATCAAGCGGACCGTGGCCGCTCCCAGCGTGTTCA
TCTTCCCACCCTCCGACGAGCAGCTGAAGTCCGGCACCGCCAGCGTCGTGTGCCTGCTGAACAACTTCTA
CCCCCGCGAGGCCAAGGTGCAGTGGAAGGTGGACAACGCCCTGCAGTCCGGCAACTCCCAGGAATCCGTC
ACCGAGCAGGACTCCAAGGACAGCACCTACTCCCTGTCCTCCACCCTGACCCTGTCCAAGGCCGACTACG
AGAAGCACAAGGTGTACGCCTGCGAAGTGACCCACCAGGGCCTGTCCAGCCCCGTGACCAAGTCCTTCAA
CCGCGGCGAGTGC] (SEQ ID NO: 328)

[spacer (SEQ ID NO: 645)][huCD71Lc_TF01_3001 (SEQ ID NO: 652)]
Amino Acid sequence
[QGQSGQG][QFCPWSYYLIGDCDIGGGSSGGSAVGLLAPPGGLSGRSDNHGGGSDIQMTQSPSSLSASVG
DRVTITCSASSSVYYMYWFQQKPGKAPKLWIYSTSNLASGVPSRFSGSGSGTDYILTISSMQPEDFATYY
CQQRRNYPYTFGQGTKLEIKRIVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
329)

[spacer (SEQ ID NO: 662)][huCD71Lc_TF01_3001 (SEQ ID NO: 653)]1
Nucleotide sequence
[CAGGGCCAGTCCGGCCAGGGA][CAGTTCTGCCCTTGGTCCTACTACCTGATCGGCGACTGCGACATCG
GCGGAGGCTCCTCTGGCGGCTCTGCTGTGGGCCTGCTGGCTCCACCTGGCGGCCTGTCCGGCAGATCTGA
CAACCACGGCGGCTCCGACATCCAGATGACCCAGTCCCCCTCCAGCCTGTCCGCCTCCGTGGGCGACAGA
GTGACAATCACCTGTTCCGCCAGCTCCTCCGTGTACTACATGTACTGGTTCCAGCAGAAGCCCGGAAAGG
CCCCCAAGCTGTGGATCTACTCCACCTCCAACCTGGCCTCCGGCGTGCCCTCCAGATTCTCCGGCTCTGG
CTCCGGCACCGACTACACCCTGACCATCTCCAGCATGCAGCCCGAGGACTTCGCCACCTACTACTGCCAG
CAGCGGCGGAACTACCCCTACACCTTCGGCCAGGGCACCAAGCTGGAAATCAAGCGGACCGTGGCCGCTC
CTTCCGTGTTCATCTTCCCACCCTCCGACGAGCAGCTGAAGAGCGGCACCGCCAGCGTGGTCTGCCTGCT
GAACAACTTCTACCCCCGCGAGGCCAAGGTGCAGTGGAAGGTGGACAACGCCCTGCAGTCCGGCAACTCC
CAGGAATCCGTCACCGAGCAGGACTCCAAGGACAGCACCTACTCCCTGTCCTCCACCCTGACCCTGTCCA
AGGCCGACTACGAGAAGCACAAGGTGTACGCCTGCGAAGTGACCCACCAGGGCCTGTCCAGCCCCGTGAC
CAAGTCCTTCAACCGGGGCGAGTGC] (SEQ ID NO: 330)

[spacer (SEQ ID NO: 645)][huCD71Lc_TF02.13_2001 (SEQ ID NO: 654)]
Amino Acid sequence
[QGQSGQG][NLCTEHSAALDCRSYGGGSSGGSISSGLLSGRSDNHGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
331)

[spacer (SEQ ID NO: 663)][huCD71Lc_TF02.13_2001 (SEQ ID NO: 655)]
Nucleotide sequence
[CAGGGACAGTCTGGCCAGGGC][AACCTGTGCACCGAGCACTCTGCCGCTCTGGACTGCAGATCCTACG
GCGGAGGCTCCTCCGGCGGCTCCATCTCCTCGGCCTGCTGTCCGGCAGATCCGACAACCATGGCGGCGG
ATCCGACATCCAGATGACCCAGTCCCCCTCCAGCCTGTCCGCCTCCGTGGGCGACAGAGTGACAATCACC
TGTTCCGCCAGCTCCTCCGTGTACTACATGTACTGGTTCCAGCAGAAGCCCGGCAAGGCCCCCAAGCTGT
GGATCTACTCCACCAGCAACCTGGCCTCCGGCGTGCCCTCCAGATTCTCCGGCTCTGGCTCCGGCACCGA
CTACACCCTGACCATCTCCAGCATGCAGCCCGAGGACTTCGCCACCTACTACTGCCAGCAGCGGCGGAAC
TACCCCTACACCTTCGGACAGGGCACCAAGCTGGAAATCAAGCGGACCGTGGCCGCTCCCAGCGTGTTCA
TCTTCCCACCCTCCGACGAGCAGCTGAAGTCCGGCACCGCCAGCGTGGTCTGCTGCTGAACAACTTCTA
CCCCCGCGAGGCCAAGGTGCAGTGGAAGGTGGACAACGCCCTGCAGTCCGGCAACTCCCAGGAATCCGTC
ACCGAGCAGGACTCCAAGGACAGCACCTACTCCCTGTCCTCCACCCTGACCCTGTCCAACGCCGACTACG
AGAAGCACAAGGTGTACGCCTGCGAAGTGACCCACCAGGGCCTGTCCAGCCCCGTGACCAAGTCCTTCAA
CCGGGGCGAGTGC] (SEQ ID NO: 332)

TABLE C-continued

Anti-CD71 Activatable Antibody Sequences

[spacer (SEQ ID NO: 645)][huCD71Lc_TF02.13_3001 (SEQ ID NO: 656)]
Amino Acid sequence
[QGQSGQG][NLTCTEHSAALDCRSYGGGSSGGSAVGLLPPGGLSGRSDNHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
333)

[spacer (SEQ ID NO: 664)][huCD71Lc_TF02.13_3001 (SEQ ID NO: 657)]
Nucleotide sequence
[CAGGGCCAGTCTGGACAGGGC][AACCTGTGCACCGAGCACTCTGCCGCTCTGGACTGCAGATCCTACG
GCGGAGGCTCCTCTGGCGGCTCTGCTGTGGGCCTGCTGGCTCCACCTGGCGGCCTGTCCGGCAGATCTGA
CAACCACGGCGGCTCCGACATCCAGATGACCCAGTCCCCCTCCAGCCTGTCTGCCTCCGTGGGCGACAGA
GTGACAATCACCTGTTCCGCCAGCTCCTCCGTGTACTACATGTACTGGTTCCAGCAGAAGCCCGGCAAGG
CCCCCAAGCTGTGGATCTACTCCACCTCCAACCTGGCCTCCGGCGTGCCCTCCAGATTCTCCGGCTCTGG
CTCCGGCACCGACTACACCCTGACCATCTCCAGCATGCAGCCCGAGGACTTCGCCACCTACTACTGCCAG
CAGCGGCGGAACTACCCCTACACCTTCGGACAGGGCACCAAGCTGGAAATCAAGCGGACCGTGGCCGCTC
CCTCCGTGTTCATCTTCCCACCCTCCGACGAGCAGCTGAAGTCCGGCACCGCCAGCGTGGTCTGCCTGCT
GAACAACTTCTACCCCCGCGAGGCCAAGGTGCAGTGGAAGGTGGACAACGCCCTGCAGTCCGGCAACTCC
CAGGAATCCGTCACCGAGCAGGACTCCTAAGGACAGCACCTACTCCCTGTCCTCCACCCTGACCTGTCCA
AGGCCGACTACGAGAAGCACAAGGTGTACGCCTGCGAAGTGACCCACCAGGGCCTGTCCAGCCCCGTGAC
CAAGTCCTTCAACCGGGGCGAGTGC] (SEQ ID NO: 334)

[spacer(SEQ ID NO: 645)][huCD71Lc_TF02.18_2001 (SEQ ID NO: 658)]
Amino Acid sequence
[QGQSGQG][CTEHSFALDCGGGSSGGSISSGLLSGRSDNHGGSDIQMTQSPSSLSASVGDRVTITCSA
SSSVYYMYWFQQKPGKAFKLWIYSTSNLASGVPSRFSGSGSGTDYTLTISSMQPEDFATYYCQQRRNYPY
TFGQGTKLEIKRTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC] (SEQ ID NO: 335)

[spacer (SEQ ID NO: 665)][huCD71Lc_TF02_2001 (SEQ ID NO: 659)]
Nucleotide sequence
[CAGGGCCAGTCTGGCCAGGGC][TGCACCGAGCACAGCTTCGCCCTGGACTGTGGCGGCGGATCCTCCG
GCGGCTCCATCTCCTCTGGCCTGCTGTCCGGCAGATCCGACAACCACGGCGGAGGCTCCGACATCCAGAT
GACCCAGTCCCCCTCCAGCCTGTCCGCCTCCGTGGGCGACAGAGTGACAATCACCTGTTCCGCCAGCTCC
TCCGTGTACTACATGTACTGGTTCCAGCAGAAGCCCGGCAAGGCCCCCAAGCTGTGGATCTACTCCACCT
CCAACCTGGCCTCCGGCGTGCCCTCCAGATTCTCCGGCTCTGGCTCCGGCACCGACTACACCCTGACCAT
CTCCAGCATGCAGCCCGAGGACTTCGCCACCTACTACTGCCAGCAGCGGCGGAACTACCCCTACACCTTC
GGCCAGGGCACCAAGCTGGAAATCAAGCGGACCGTGGCCGCTCCCTCCGTGTTCATCTTCCCACCCTCCG
ACGAGCAGCTGAAGTCCGGCACCGCCAGCGTGGTGTGCCTGCTGAACAACTTCTACCCCCGCGAGGCCAA
GGTGCAGTGGAAGGTGGACAACGCCCTGCAGTCCGGCAACTCCCAGGAATCCGTGACCGAGCAGGACTCC
AAGGACAGCACCTACTCCCTGTCCTCCACCCTGACCCTGTCCAAGGCCGACTACGAGAAGCACAAGGTGT
ACGCCTGCGAAGTGACCCACCAGGGCCTGTCCAGCCCCGTGACCAAGTCCTTCAACCGGGGCGAGTGC]
(SEQ ID NO: 336)

[spacer (SEQ ID NO: 645)][huCD71Lc_TF02.18_3001 (SEQ ID NO: 660)]
Amino Acid sequence
[QGQSGQG][CTEHSFALDCGGGSSGGSAVGLLAPPGGLSGRSDNHGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIKRTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC] (SEQ ID NO: 337)

[spacer (SEQ ID NO: 665)][huCD71Lc_TF02.18_3001 (SEQ ID NO: 661)]
Nucleotide sequence
[CAGGGCCAGTCTGGCCAGGGC][TGCACCGAGCACAGCTTCGCCCTGGACTGTGGCGGCGGATCTTCTG
GCGGCTCTGCTGTGGGCCTGCTGGCTCCTCCTGGCGGCCTGTCCGGCAGATCTGACAACCACGGCGGCTC
CGACATCCAGATGACCCAGTCCCCCTCCAGCCTGTCCGCCTCCGTGGGCGACAGAGTGACAATCACCTGT
TCCGCCAGCTCCTCCGTGTACTACATGTACTGGTTCCAGCAGAAGCCCGGCAAGGCCCCCAAGCTGTGGA
TCTACTCCACCTCCAACCTGGCCTCCGGCGTGCCCTCCAGATTCTCCGGCTCTGGCTCCGGCACCGACTA
CACCCTGACCATCTCCAGCATGCAGCCCGAGGACTTCGCCACCTACTACTGCCAGCAGCGGCGGAACTAC
CCCTACACCTTCGGCCAGGGCACCAAGCTGGAAATCAAGCGGACCGTGGCCGCTCCCTCCGTGTTCATCT
TCCCACCCTCCGACGAGCAGCTGAAGTCCGGCACCGCCAGCGTGGTGTGCCTGCTGAACAACTTCTACCC
CCGCGAGGCCAAGGTGCAGTGGAAGGTGGACAACGCCCTGCAGTCCGGCAACTCCCAGGAATCCGTGACC
GAGCAGGACTCCAAGGACAGCACCTACTCCCTGTCCTCCACCCTGACCCTGTCCAAGGCCGACTACGAGA
AGCACAAGGTGTACGCCTGCGAAGTGACCCACCAGGGCCTGTCCAGCCCCGTGACCAAGTCCTTCAACCG
GGGCGAGTGC] (SEQ ID NO: 338)

[spacer (SEQ ID NO: 645)][huCD71Lc_TF02.13_2012 (SEQ ID NO: 670)]
Amino Acid sequence
[QGQSGQG][NLCTEHSAALDCRSYGGGSSGGSISSGLLSGRSANPGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
671)

TABLE C-continued

Anti-CD71 Activatable Antibody Sequences

[spacer (SEQ ID NO: 674)][huCD71Lc_TF02.13_2012 (SEQ ID NO: 675)]
Nucleotide sequence
[CAGGGACAGTCAGGCCAGGGC][AATCTCTGCACGGAGCATAGCGCCGCACTTGACTGTCGATCTTACG
GCGGCGGTTCCTCTGGAGGCTCTATATCATCCGGACTCCTCTCAGGCAGAAGCGCTAATCCTGGCGGCGG
ATCTGATATACAAATGACTCAGTCACCAAGCTCCCTGAGTGCGTTGGTGATAGGGTGACGATCACT
TGTAGTGCGAGCTCATCTGTTTATTATATGTACTGGTTTCAACAGAAACCCGGAAAAGCACCTAAGTTGT
GGATCTACAGTACCTCCAATCTGGCTTCCGGCGTCCCCAGCCGGTTTTCCGGCTCTGGAAGCGGAACGGA
TTACACGCTCACCATATCCTCTATGCAACCTGAAGATTTCGCAACTTACTACTGTCAGCAACGCAGGAAT
TATCCATATACATTTGGTCAAGGGACTAAGCTCGAAATCAAGCGTACGGTGGCTGCACCATCTGTCTTCA
TCTTCCCGCCATCTGATGAGCAGTTGAAATCTGGAACTGCCTCTGTTGTGTGCCTGCTGAATAACTTCTA
TCCCAGAGAGGCCAAAGTACAGTGGAAGGTGGATAACGCCCTCCAATCGGGTAACTCCCAGGAGAGTGTC
ACAGAGCAGGACAGCAAGGACAGCACCTACAGCCTCAGCAGCACCCTGACGCTGAGCAAGCAGACTACG
AGAAACACAAAGTCTACGCCTGCGAAGTCACCCATCAGGGCCTGAGCTCGCCCGTCACAAAGAGCTTCAA
CAGGGGAGAGTGT](SEQ ID NO: 676)

[spacer(SEQ ID NO: 645)][huCD71Lc_TF02.13_3011 (SEQ ID NO: 672)]
Amino Acid sequence
[QGQSGQG][NLCTEHSAALDCRSYGGGSSGGSAVGLLAPPGGLSGRSDNPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
673)

[spacer (SEQ ID NO: 7)][huCD71Lc_TF02.13_3011 (SEQ ID NO: 678)]
Nucleotid.e sequence
[CAAGGGCAGTCCGGTCAAGGG][AACTTGTTACAGAGCATTCTGCCGCCCTTACTGCAGGTCTTACG
GCGGAGGGAGTAGTGGCGGGAGCGCGGTGGGACTTCTGGCACCCACCTGGTGGGTTGTCAGGCAGGAGCGA
CAATCCAGGGGGGTCAGACATCCAGATGACACAAAGTCCGAGTAGTCTCTCAGCTAGTGTGGGCGATAGA
GTCACAATTACATGTAGTGCGTCCAGTAGCGTGTACTACATGTACTGGTTTCAGCAGAAGCCGGGCAAAG
CACCGAAACTGTGGATTTACAGTACCAGCAACCTCGCCAGCGGTGTTCCCTCTCGATTTTCAGGGAGTGG
GAGTGGGACCGACTACACGCTCACCATCTCAAGTATGCAGCCAGAAGATTTCGCTACCTACTATTGCCAG
CAGCGCGGGAATTATCCCTACACGTTCGGTCAAGGCACAAAATCTGGAAATCAAACGTACGGTGGCTGCAC
CATCTGTCTTCATCTTCCCGCCATCTGATGAGCAGTTGAAATCTGGAACTGCCTCTGTTGTGTGCCTGCT
GAATAACTTCTATCCCAGAGAGGCCAAAGTACAGTGGAAGGTGGATAACGCCCTCCAATCGGGTAACTCC
CAGGAGAGTGTCACAGAGCAGGACAGCAAGGACAGCACCTACAGCCTCAGCAGCACCCTGACGCTGAGCA
AGCAGACTACGAGAAACACAAAGTCTACGCCTGCGAAGTCACCCATCAGGGCCTGAGCTCGCCCGTCAC
AAAGAGCTTCAACAGGGGAGAGTGT] (SEQ ID NO: 679)

[spacer (SEQ ID NO: 645)][huCD71Lc_TF02.13_2011 (SEQ ID NO: 701)]
Amino Acid sequence
[QGQSGQG][NLCTEHSAALDCRSYGGGSSGGSISSGLLSGRSDNPGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLYLSKADYEKHEVYACEVTHQGLSSPVTKSFNRGEC](SEQ ID NO:
702)

[spacer (SEQ ID NO: 645)][huCD71Lc_TF02.13_3012 (SEQ ID NO: 703)]
Amino Acid sequence
[QGQSGQG][NLCTEHSTAALDCRSYGGGSSGGSAVGLLAPPGGLSGRSANPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
704)

[spacer (SEQ ID NO: 645)][huCD71Lc_TF02.18_2011 (SEQ ID NO: 705)]
Amino Acid sequence
[QGQSGQG][CTEHSFALDCGGGSSGGSISSGLLSGRSDNPGGSDIQMTQSPSSLSASVGDRVTITCSA
SSSVYYMYWFQQKPGKAPKLWIYSTSNLASGVPSRFSGSGSGIDYTLTISSMQPEDFATYYCQQRRNYPY
TFGQGTKLEIKRTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC] (SEQ ID NO: 706)

[spacer (SEQ ID NO: 645)][huCD71Lc_TF02.18_3012 (SEQ ID NO: 707)]
Amino Acid sequence
[QGQSGQG][CTEHSFALDCGGGSSGGSAVGLLAPPGGLSGRSANPGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIKRTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC] (SEQ ID NO: 708)

[spacer (SEQ ID NO: 645)][huCD71Lc_TF02.18_2012 (SEQ ID NO: 709)]
Amino Acid sequence
[QGQSGQG][CTEHSFALDCGGGSSGGSISSGLLSGRSANPGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIKRTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC] (SEQ ID NO: 710)

TABLE C-continued

Anti-CD71 Activatable Antibody Sequences

[spacer (SEQ ID NO: 645)][huCD71Lc_TF02.18_3011 (SEQ ID NO: 711)]
Amino Acid sequence
[QGQSGQG][CTEHSFALDCGGGSSGGSAVGLLAPPGGLSGRSDNPGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIKRTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC] (SEQ ID NO: 712)

[spacer (SEQ ID NO: 645)][huCD71Lc_TF02.13_NSUB (SEQ ID NO: 715)]
Amino Acid sequence
[QGQSGQG][NLCTEHSAALDCRSYGGGSSGGSGGSGGSGGGSGGGSGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
716)

[spacer (SEQ ID NO: 717)][huCD71Lc_TF02.13_NSUB (SEQ ID NO: 718)]
Nucleotide sequence
[CAAGGCCAGTCTGGCCAGGGT][AATTTGTGCACGGAGCATAGTGCACTCTCTGGATTGCCGGAGTTATG
GAGGTGGCTCGAGCGGAGGCAGCGGAGGTTCAGGCGGGAGCGGTGGGGGGTCAGGAGGTGGCTCTGGAGG
CTCAGACATCCAGATGACCCAGTCCCCCTCTTCCCTCTCTGCCAGCGTGGGTGATCGAGTGACAATTACA
TGTTCCGCCTCTTCTAGCGTATACTATATGTACTGGTTTCAGCAGAAACCTGGAAAAGCCCCCAAACTGT
GGATCTATTCTACTAGCAACCTGGCCTCCGGAGTCCCATCCGGGTTCTCTGGCAGCGGTTCTGGAACCGA
CTACACTCTGACCATCTCTTCTATGCAACCAGAGGACTTTGCTACTTACTACTGTCAACAGAGAAGGAAC
TATCCTTATACTTTCGGTCAGGGAACTAAGCTGGAAATCAAGCGTACGGTGGCTGCACCATCTGTCTTCA
TCTTCCCGCCATCTGATGAGCAGTTGAAATCTGGAACTGCCTCTGTTGTGTGCCTGCTGAATAACTTCTA
TCCCAGAGAGGCCAAAGTACAGTGGAAGGTGGATAACGCCCTCCAATCGGGTAACTCCCAGGAGAGTGTC
ACAGAGCAGGACAGCAAGGACAGCACCTACAGCCTCAGCAGCACCCTGACGCTGAGCAAAGCAGACTACG
AGAAACACAAAGTCTACGCCTGCGAAGTCACCCATCAGGGCCTGAGCTCGCCCGTCACAAAGAGCTTCAA
CAGGGGAGAGTGT] (SEQ ID NO: 719)

[spacer (SEQ ID NO: 645)][huCD71Lc_TF02.18_NSUB (SEQ ID NO: 720)]
Amino Acid sequence
[QGQSGQG][CTEHSFALDCGGGSSGGSGGSGGSGGGSGGGSGGSDIQMTQSPSSLSASVGDRVTITCSA
SSSVYYMYWFQQKPGKAPKLWIYSTSNLASGVPSRFSGSGSGTDYLTISSMQPEDFATYYCQQRRNYPY
TFGQGTKLEIKRTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC] (SEQ ID NO: 315)

[spacer (SEQ ID NO: 645)][huCD71Lc_TF02.13_2007 (SEQ ID NO: 721)]
Amino Acid sequence
[QGQSGQG][NLCTEHSAALDCRSYGGGSSGGSISSGLLSGRSDIHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
722)

spacer (SEQ ID NO: 645)][huCD71Lc_TF02.13_2008 (SEQ ID NO: 723)]
Amino Acid sequence
[QGQSGQG][NLCTEHSAALDCRSYGGGSSGGSISSGLLSGRSDQHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
724)

spacer (SEQ ID NO: 645)][huCD71Lc_TF02.13_2013 (SEQ ID NO: 725)]
Amino Acid sequence
[QGQSGQG][NLCTEHSAALDCRSYGGGSSGGSISSGLLSGRSANIGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
726)

[spacer (SEQ ID NO: 645)][huCD71Lc_TF02.13_3007 (SEQ ID NO: 727)]
Amino Acid sequence
[QGQSGQG][NLCTEHSAALDCRSYGGGSSGGSAVGLLAPPGGLSGRSDIHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
728)

[spacer (SEQ ID NO: 645)][huCD71Lc_TF02.13_3008 (SEQ ID NO: 729)]
Amino Acid sequence
[QGQSGQG][NLCTEHSAALDCRSYGGGSSGGSAVGLLAPPGGLSGRSDQHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
730)

TABLE C-continued

Anti-CD71 Activatable Antibody Sequences

[spacer (SEQ ID NO: 645)][huCD71Lc_TF02.13_3013 (SEQ ID NO: 731)]
Amino Acid sequence
[QGQSGQG][NLCTEHSAALDCRSYGGGSSGGSAVGLLAPPGGLSGRSANIGGSDIQMTQSPSSLSASVG
DRVTITCSASSSVYYMYWFWKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQQSVTEQDSKDSTYSLSSTLTLSKADYEKHKVYACEVTHQGLSSPVTKSFNRGEC] (SEQ ID NO:
732)

[spacer (SEQ ID NO: 645)][huCD71Lc_TF02.18_2007 (SEQ ID NO: 733)]
Amino Acid sequence
[QGQSGQG][CTEHSFALDCGGGSSGGSISSGLLSGRSDIHGGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIKRTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC] (SEQ ID NO: 734)

[spacer (SEQ ID NO: 645)][huCD71Lc_TF02.18_2008 (SEQ ID NO: 735)]
Amino Acid sequence
[QGQSGQG][CTEHSFALDCGGGSSGGSISSGLLSGRSDQHGGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIKRTVAAPSVFIFPPSDEQLKSGTASVVCLLNNFYPREAKVQWKVDNALQSGNSQESVIEQ
DSKDSTYSLSSTLTLSKADYEKHKVYACEVTHQGLSSPVTKSFNRGEC] (SEQ ID NO: 736)

[spacer (SEQ ID NO: 645)][huCD71Lc_TF02.18_2013 (SEQ ID NO: 737)]
Amino Acid sequence
[QGQSGQG][CTEHSFALDCGGGSSGGSISSGLLSGRSANIGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIKRTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC] (SEQ ID NO: 738)

[spacer (SEQ ID NO: 645)][huCD71Lc_TF02.18_3007 (SEQ ID NO: 739)]
Amino Acid sequence
[QGQSGQG][CTEHSFALDCGGGSSGGSAVGLLAPPGGLSGRSDIHGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIKRTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC] (SEQ ID NO: 740)

[spacer (SEQ ID NO: 645)][huCD71Lc_TF02.18_3008 (SEQ ID NO: 741)]
Amino Acid sequence
[QGQSGQG][CTEHSFALDCGGGSSGGSAVGLLAPPGGLSGRSDQHGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIKRTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC] (SEQ ID NO: 742)

[spacer (SEQ ID NO: 645)][huCD71Lc_TF02.18_3013 (SEQ ID NO: 743)]
Amino Acid sequence
[QGQSGQG][CTEHSFALDCGGGSSGGSAVGLLAPPGGLSGRSANIGGSDIQMTQSPSSLSASVGDRVTI
ICSASSSVYYMYWFQQKPGKAPKLWIYSTSNLASGVPSRFSGSGSGTDYTLTISSMQPEDFATYYCQQRR
NYPYTFGQGTKLEIKRTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC] (SEQ ID NO: 744)

[spacer (SEQ ID NO: 645)][huCC71Lc_TF01_2007 (SEQ ID NO: 745)]
Amino Acid Sequence
[QGQSGQG][QFCPWSYYLIGDCDIGGGSSGGSISSGLLSGRSDIHGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHEVYACEVTHQGLSSPVTKSFNRGEC] (SEQ ID NO:
746)

[spacer (SEQ ID NO: 645)][huCD71Lc_TF01_3007 (SEQ ID NO: 747)]
Amino Acid sequence
[QGQSGQG][QFCPWSYYLIGDCDIGGGSSGGSAVGLLAPPGGLSGRSDIHGGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
748)

[spacer (SEQ ID NO: 645)][huCD71Lc_TF01_2008 (SEQ ID NO: 749)]
Amino Acid Sequence
[QGQSGQG][QFCPWSYYLIGDCDIGGGSSGGSISSGLLSGRSDQHGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
750)

[spacer (SEQ ID NO: 645)][huCD71Lc_TF01_3008 (SEQ ID NO: 751)]
Amino Acid sequence
[QGQSGQG][QFCPWSYYLIGDCDIGGGSSGGSAVGLLAPPGGLSGRSDQHGGSDIQMTQSPSSLSASVG
DRVTITCSASSSVYYMYWFQQKPGKAPKLWIYSTSNLASGVPSRFSGSGSGTDYTLTISSMQPEDFATYY TABLE C-continued Anti-CD71 Activatable Antibody Sequences CQQRRNYPYTFGQGTKLEIKRTVAAPSVFIFPPSDEQLKEGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
752)

[spacer (SEQ ID NO: 645)][huCD71Lc_TF01_2011 (SEQ ID NO: 753)]
Amino Acid Sequence
[QGQSGQG][QFCPWSYYLIGDCDIGGGSSGGSISSGLLSGRSDNPGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
754)

[spacer (SEQ ID NO: 645)][huCD71Lc_TF01_3011 (SEQ ID NO: 755)]
Amino Acid sequence
[QGQSGQG][QFCPWSYYLIGDCDIGGGSSGGSAVGLLAPPGGLSGRSDNPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
756)

[spacer (SEQ ID NO: 645)][huCD71Lc_TF01_2012 (SEQ ID NO: 757)]
Amino Acid Sequence
[QGQSGQG][QFCPWSYYLIGDCDIGGGSSGGSISSGLLSGRSANPGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNEYPREAKVQWKVDNALQSGNSQE
SVTEQDSKDSTYSLSSTLTLSKADYEKHKVYACEVTHQGLSSPVTKSFNRGEC] (SEQ ID NO:
758)

[spacer (SEQ ID NO: 645)][huCD71Lc_TF01_3012 (SEQ ID NO: 759)]
Amino Acid sequence
[QGQSGQG][QFCPWSYYLIGDCDIGGGSSGGSAVGLLAPPGGLSGRSANPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
760)

[spacer (SEQ ID NO: 645)][huCD71Lc_TF01_2013 (SEQ ID NO: 761)]
Amino Acid Sequence
[QGQSGQG][QFCPWSYYLIGDCDIGGGSSGGSISSGLLSGRSANIGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
762)

[spacer (SEQ ID NO: 645)][huCD71Lc_TF01_3013 (SEQ ID NO: 763)]
Amino Acid sequence
[QGQSGQG][QFCPWSYYLIGDCDIGGGSSGGSAVGLLAPPGGLSGRSANIGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
764)

[spacer (SEQ ID NO: 645)][huCD71Lc_TF02_2001 (SEQ ID NO: 765)]
Amino Acid Sequence
[QGQSGQG][NLCTEHSFALDCRSYGGGSSGGSISSGLLSGRSDNHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
766)

[spacer (SEQ ID NO: 645)][huCD71Lc_TF02_3001 (SEQ ID NO: 767)]
Amino Acid sequence
[QGQSGQG][NLCTEHSFALDCREYGGGSSGGSAVGLLAPPGGLSGRSDNHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
768)

[spacer (SEQ ID NO: 645)][huCD71Lc_TF02_2007 (SEQ ID NO: 769)]
Amino Acid Sequence
[QGQSGQG][NLCTEHSFALDCRSYGGGSSGGSISSGLLSGRSDIHGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDFSKDSTYSLSSTLTLSKADYEKHKVYACEVTHQGLSSPVTKSFNRGEC] (SEQ ID NO:
770)

TABLE C-continued

Anti-CD71 Activatable Antibody Sequences

[spacer (SEQ ID NO: 645)][huCD71Lc_TF02_3007 (SEQ ID NO: 771)]
Amino Acid sequence
[QGQSGQG][NLCTEHSFALDCRSYGGGSSGGSAVGLLAPPGGLSGRSDIHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
772)

[spacer (SEQ ID NO: 645)][huCD71Lc_TF02_2008 (SEQ ID NO: 773)]
Amino Acid Sequence
[QGQSGQG][NLCTEHSFALDCRSYGGGSSGGSISSGLLSGRSDQHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
774)

[spacer (SEQ ID NO: 645)][huCD71Lc_TF02_3008 (SEQ ID NO: 775)]
Amino Acid sequence
[QCQSGQG][NLCTEHSFALDCRSYGGGSSGGSAVGLLAPPGGLSGRSDQHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
776)

[spacer (SEQ ID NO: 645)][huCD71Lc_TF02_2011 (SEQ ID NO: 777)]
Amino Acid Sequence
[QGQSGQG][NLCTEHSFALDCRSYGGGSSGGSISSGLLSGRSDNPGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
778)

[spacer (SEQ ID NO: 645)][1-mCD71Lc_TF02_3011 (SEQ ID NO: 779)]
Amino Acid sequence
[QGQSGQG][NLCTEHSFALDCRSYGGGSSGGSAVGLLAPPGGLSGRSDNPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
780)

[spacer (SEQ ID NO: 645)][huCD71Lc_TF02_2012 (SEQ ID NO: 781)]
Amino Acid Sequence
[QGQSGQG][NLCTEHSFALDCRSYGGGSSGGSISSGLLSGRSANPGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
782)

[spacer (SEQ ID NO: 645)][huCD71Lc_TF02_3012 (SEQ ID NO: 783)]
Amino Acid sequence
[QCQSGQG][NLCTEHSFALDCRSYGGGSSGGSAVGLLAPPGGLSGRSANPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
784)

[spacer (SEQ ID NO: 645)][huCD71Lc_TF02_2013 (SEQ ID NO: 785)]
Amino Acid Sequence
[QGQSGQG][NLCTEHSFALDCRSYGGGSSGGSISSGLLSGRSANIGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC] (SEQ ID NO:
786)

[spacer (SEQ ID NO: 645)][huCD71Lc_TF02_3013 (SEQ ID NO: 787)]
Amino Acid sequence
[QGQSGQG][NLCTEHSFALDCRSYGGGSSGGSAVGLLAPPGGLSGRSANIGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIKRTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC] (SEQ ID NO:
788)

[spacer (SEQ ID NO: 645)][huCD71Lc_TF01_2001 VL domain (SEQ ID NO: 809)]
Amino Acid sequence
[QGQSGQG][QFCPWSYYLIGDCDIGGGSSGGSISSGLLSGRSDNHGGSDIQMTQSPSSLSASV
GDRVTITCSASSSVYYMYWFQQKPGKAPKLWIYSTSNLASGVPSRFSGSGSGTDYTLTISSMQP
EDFATYYCQQRRNYPYTFGQGTKLEIK] (SEQ ID NO: 810)

TABLE C-continued

Anti-CD71 Activatable Antibody Sequences

[spacer (SEQ ID NO: 645)][huCD71Lc_TF01_3001 VL domain (SEQ ID NO: 811)]
Amino Acid sequence
[QGQSGQG][QFCPWSYYLIGDCDIGGGSSGGSAVGLLAPPGGLSGRSDNHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 812)

[spacer (SEQ ID NO: 645)][huCD71Lc_TF02_2001 VL domain (SEQ ID NO: 813)]
Amino Acid sequence
[QGQSGQG][NLCTEHSAALDCRSYGGGSSGGSISSGLLSGRSDNHGGSDIQMTQSPSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 814)

[spacer (SEQ ID NO: 645)][huCD71Lc_TF02.13_3001 VL domain (SEQ ID NO: 815)]
Amino Acid sequence
[QGQSGQG][NLCTEHSAALDCRSYGGGSSGGSAVGLLAPPGGLSGRSDNHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 816)

[spacer (SEQ ID NO: 645)][huCD71Lc_TF02.18_2001 VL domain (SEQ ID NO: 817)]
Amino Acid sequence
[QGQSGQG][CTEHSFALDCGGGSSGGSISSGLLSGRSDNHGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIK] (SEQ ID NO: 818)

[spacer (SEQ ID NO: 645)][huCD71Lc_TF02.18_3001 VL domain (SEQ ID NO: 819)]
Amino Acid sequence
[QGQSGQG][CTEHSFALDCGGGSSGGSAVGLLAPPGGLSGRSDNHGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIK] (SEQ ID NO: 820)

[spacer (SEQ ID NO: 645)][huCD71Lc_TF02.13_2012 VL domain (SEQ ID NO: 821)]
Amino Acid sequence
[QGQSGQG][NLCTEHSAALDCRSYGGGSSGGSISSGLLSGRSANPGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 822)

[spacer (SEQ ID NO: 645)][huCD71Lc_TF02.13_3011 VL domain (SEQ ID NO: 823)]
Amino Acid sequence
[QGQSGQG][NLCTEHSAALDCRSYGGGSSGGSAVGLLAPPGGLSGRSDNPGGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLE1K] (SEQ ID NO: 824)

[spacer (SEQ ID NO: 645)][huCD71Lc_TF02.13_2011 VL domain (SEQ ID NO: 825)]
Amino Acid sequence
[QGQSGQG][NLCTEHSAALDCRSYGGGSSGGSISSGLLSGRSDNPGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 826)

[spacer (SEQ ID NO: 645)][huCD71Lc_TF02.13_3012 VL domain (SEQ ID NO: 827)]
Amino Acid sequence
[QGQSGQG][NLCTEHSAALDCRSYGGGSSGGSAVGLLAPPGGLSGRSANPGGGSDIQMTQSPSSLSASVG
DRVTITCSASSSVYYMYWFQQKPGKAPKLWISTSNLASGVPSRFSGSGSGTDYTLTISSMQPEDFATYY
CQQRRNYPYTFGQGTKLEIK] (SEQ ID NO: 828)

[spacer (SEQ ID NO: 645)][huCD71Lc_TF02.18_2011 VL domain (SEQ ID NO: 829)]
Amino Acid sequence
[QGQSGQG][CTEHSFALDCGGGSSGGSISSGLLSGRSDNPGGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIK] (SEQ ID NO: 830)

[spacer (SEQ ID NO: 645)][huCD71Lc_TF02.18_3012 VL domain (SEQ ID NO: 831)]
Amino Acid sequence
[QGQSGQG][CTEHSFALDCGGGSSGGSAVGLLAPPGGLSGRSANPGGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIK] (SEQ ID NO: 832)

[spacer (SEQ ID NO: 645)][huCD71Lc_TF02.18_2012 VL domain (SEQ ID NO: 833)]
Amino Acid sequence
[QGQSGQG][CTEHSFALDCGGGSSGGSISSGLLSGRSANPGGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIK] (SEQ ID NO: 834)

[spacer (SEQ ID NO: 645)][huCD71Lc_TF02.18_3011 VL domain (SEQ ID NO: 835)]
Amino Acid sequence
[QGQSGQG][CTEHSFALDCGGGSSGGSAVGLLAPPGGLSGRSDNPGGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIK] (SEQ ID NO: 836)

TABLE C-continued

Anti-CD71 Activatable Antibody Sequences

[spacer (SEQ ID NO: 645)][huCD71Lc_TF02.13_NSUB VL domain (SEQ ID NO: 837)]
Amino Acid sequence
[QGQSGQG][NLCTEHSAALDCRSYGGGSSGGSGGSGGSGGGSGGGSGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 838)

[spacer (SEQ ID NO: 645)][huCD71Lc_TF02.18_NSUB VL domain (SEQ ID NO: 839)]
Amino Acid sequence
[QGQSGQG][CTEHSFALDCGGGSSGGSGGSGGSGGGSGGGSGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIK] (SEQ ID NO: 840)

[spacer (SEQ ID NO: 645)][huCD71Lc_TF02.13_2007 VL domain (SEQ ID NO: 841)]
Amino Acid sequence
[QGQSGQG][NLCTEHSAALDCRSYGGGSSGGSISSGLLSGRSDIHGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 842)

[spacer (SEQ ID NO: 645)][huCD71Lc_TF02.13_2008 VL domain (SEQ ID NO: 843)]
Amino Acid sequence
[QGQSGQG][NLCTEHSAALDCRSYGGGSSGGSISSGLLSGRSDQHGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 844)

[spacer (SEQ ID NO: 645)][huCD71Lc_TF02.13_2013 VL domain (SEQ ID NO: 845)]
Amino Acid sequence
[QGQSGQG][NLCTEHSAALDCRSYGGGSSGGSISSGLLSGRSANIGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 846)

[spacer (SEQ ID NO: 645)][huCD71Lc_TF0213_3007 VL domain (SEQ ID NO: 847)]
Amino Acid sequence
[QGQSGQG][NLCTEHSAALDCRSYGGGSSGGSAVGLLAPPGGLSGRSDIHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 848)

[spacer (SEQ ID NO: 645)][huCD71Lc_TF02.3_3008 VL domain (SEQ ID NO: 849)]
Amino Acid sequence
[QGQSGQG][NLCTEHSAALDCRSYGGGSSGGSAVGLLAPPGGLSGRSDQHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 850)

[spacer (SEQ ID NO: 645)][huCD71Lc_TF02.13_3013 VL domain (SEQ ID NO: 851)]
Amino Acid sequence
[QGQSGQG][NLCTEHSAALDCRSYGGGSSGGSAVGLLAPPGGLSGRSANIGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 852)

[spacer (SEQ ID NO: 645)][huCD71LcVL domain (SEQ ID NO: 853)]
Amino Acid sequence
[QGQSGQG][CTEHSFALDCGGGSSGGSISSGLLSGRSDIHGGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIK] (SEQ ID NO: 854)

[spacer (SEQ ID NO: 645)][huCD71Lc_TF02.18_2008 VL domain (SEQ ID NO: 855)]
Amino Acid sequence
[QGQSGQG][CTEHSFALDCGGGSSGGSISSGLLSGRSDQHGGGSDIQMTQSPSSLSASVGDRVTITCSA
SSSVYYMYWFQQKPGKAPKLWIYSTSNLASGVPSRFSGSGSGTDYTLTISSMQPEDFATYCQQRRNYPY
TFGQGTKLEIK] (SEQ ID NO: 856)

[spacer (SEQ ID NO: 645)][huCD71Lc_TF02.18_2013 VL domain (SEQ ID NO: 857)]
Amino Acid sequence
[QGQSGQG][CTEHSFALDCGGGSSGGSISSGLLSGRSANIGGGSDIQMTQSPSSLSASVGDRVTITCSA
SSSVYYMYWFQQKPGKAPKLWIYSTSNLASGVPSRFSGSGSGTDYTLTISSMQPEDFATYYCQQRRNYPY
TFGQGTKLEIK] (SEQ ID NO: 858)

[spacer (SEQ ID NO: 645)][huCD71Lc_TF02.18_3007 VL domain (SEQ ID NO: 859)]
Amino Acid sequence
[QGQSGQG][CTEHSFALDCGGGSSGGSAVGLLAPPGGLSGRSDIHGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIK] (SEQ ID NO: 860)

[spacer (SEQ ID NO: 645)][huCD71Lc_TF02.18_3008 VL domain (SEQ ID NO: 861)]
Amino Acid sequence
[QGQSGQG][CTEHSFALDCGGGSSGGSAVGLLAPPGGLSGRSDQHGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIK] (SEQ ID NO: 862)

TABLE C-continued

Anti-CD71 Activatable Antibody Sequences

[spacer (SEQ ID NO: 645)][huCD71Lc_TF02.18_3013 VL domain (SEQ ID NO: 863)]
Amino Acid sequence
[QGQSGQG][CTEHSFALDCGGGSSGGSAVGLLAPPGGLSGRSANIGGSDIQMTQSPSSLSASVGDRVTI
TCSASSSVYYMYWFQQKPGKAPKLWIYSTSNLASGVPSRFSGSGSGTDYTLTISSMQPEDFATYYCQQRR
NYPYTFGQGTKLEIK] (SEQ ID NO: 864)

[spacer (SEQ ID NO: 645)][huCD71Lc_TF01_2007 VL domain (SEQ ID NO: 865)]
Amino Acid sequence
[QGQSGQG][QFCPWSYYLIGDCDIGGGSSGGSISSGLLSGRSDIHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 866)

[spacer (SEQ ID NO: 645)][huCD71Lc_TF01_3007 VL domain (SEQ ID NO: 867)]
Amino Acid sequence
[QGQSGQG][QFCPWSYYLIGDCDIGGGSSGGSAVGLLAPPGGLSGRSDIHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 868)

[spacer (SEQ ID NO: 645)][huCD71Lc_TF01_2008 VL domain (SEQ ID NO: 869)]
Amino Acid sequence
[QGQSGQG][QFCPWSYYLIGDCDIGGGSSGGSISSGLLSGRSDQHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 870)

[spacer (SEQ ID NO: 645)][huCD71Lc_TF01_3008 VL domain (SEQ ID NO: 871)]
Amino Acid sequence
[QGQSGQG][QFCPWSYYLIGDCDIGGGSSGGSAVGLLAPPGGLSGRSDQHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 872)

[spacer (SEQ ID NO: 645)][huCD71Lc_TF01_2011 VL, domain (SEQ ID NO: 873)]
Amino Acid sequence
[QGQSGQG][QFCPWSYYLIGDCDIGGGSSGGSISSGLLSGRSDNPGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 874)

[spacer (SEQ ID NO: 645)][huCD71Lc_TF01_3011 VL domain (SEQ ID NO: 875)]
Amino Acid sequence
[QGQSGQG][QFCPWSYYLIGDCDIGGGSSGGSAVGLLAPPGGLSGRSDNPGGSDIQMTQSPSSLSASVG
DRVTITCSASSSVYYMYWFQQKPGKAPKLWIYSTSNLASGVPSRFSGFGSGTDYTLTISSMQPEDFATYY
CQQRRNYPYTFGQGTKLEIK] (SEQ ID NO: 876)

[spacer (SEQ ID NO: 645)][huCD71Lc_TF01_2012 VL domain (SEQ ID NO: 877)]
Amino Acid sequence
[QGQSGQG][QFCPWSYYLIGDCDIGGGSSGGSISSGLLSGRSANPGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 878)

[spacer (SEQ ID NO: 645)][huCD71Lc_TF01_3012 VL domain (SEQ ID NO: 879)]
Amino Acid sequence
[QGQSGQG][QFCPWSYYLIGDCDIGGGSSGGSAVGLLAPPGGLSGRSANPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 880)

[spacer (SEQ ID NO: 645)][huCD71Lc_TF01_2013 VL domain (SEQ ID NO: 881)]
Amino Acid sequence
[QGQSGQG][QFCPWSYYLIGDCDIGGGSSGGSISSGLLSGRSANIGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 882)

[spacer (SEQ ID NO: 645)][huCD71Lc_TF01_3013 VL domain (SEQ ID NO: 883)]
Amino Acid sequence
[QGQSGQG][QFCPWSYYLIGDCDIGGGSSGGSAVGLLAPPGGLSGRSANIGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 884)

[spacer (SEQ ID NO: 645)][huCD71Lc_TF02_2001 VL domain (SEQ ID NO: 885)]
Amino Acid sequence
[QGQSGQG][NLCTEHSFALDCRSYGGGSSGGSISSGLLSGRSDNHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 886)

[spacer (SEQ ID NO: 645)][huCD71Lc_TF02_3001 VL domain (SEQ ID NO: 887)]
Amino Acid sequence
[QGQSGQG][NLCTEHSFALDCRSYGGGSSGGSAVGLLAPPGGLSGRSDNHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 888)

TABLE C-continued

Anti-CD71 Activatable Antibody Sequences

[spacer (SEQ ID NO: 645)][huCD71Lc_TF02_2007 VL domain (SEQ ID NO: 889)]
Amino Acid sequence
[QGQSGQG][NLCTEHSFALDCRSYGGGSSGGSISSGLLSGRSDIHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 890)

[spacer (SEQ ID NO: 645)][huCD71Lc_TF02_3007 VL domain (SEQ ID NO: 891)]
Amino Acid sequence
[QGQSGQG][NLCTEHSFALDCRSYGGGSSGGSAVGLLAPPGGLSGRSDIHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 892)

[spacer (SEQ ID NO: 645)][huCD71Lc_TF02_2008 VL domain (SEQ ID NO: 893)]
Amino Acid sequence
[QGQSGQG][NLCTEHSFALDCRSYGGGSSGGSISSGLLSGRSDQHGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 894)

[spacer (SEQ ID NO: 645)][huCD71Lc_TF02_3008 VL domain (SEQ ID NO: 895)]
Amino Acid sequence
[QGQSGQG][NLCTEHSFALDCRSYGGGSSGGSAVGLLAPPGGLSGRSDQHGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 896)

[spacer (SEQ ID NO: 645)][huCD71Lc_TF02_2011 VL domain (SEQ ID NO: 897)]
Amino Acid sequence
[QGQSGQG][NLCTEHSFALDCRSYGGGSSGGSISSGLLSGRSDNPGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTEGQGTKLEIK] (SEQ ID NO: 898)

[spacer (SEQ ID NO: 645)][huCD71Lc_TF02_3011 VL domain (SEQ ID NO: 899)]
Amino Acid sequence
[QGQSGQG][NLCTEHSFALDCRSYGGGSSGGSAVGLLAPPGGLSGRSDNPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 900)

[spacer (SEQ ID NO: 645)][huCD71Lc_TF02_2012 VL, domain (SEQ ID NO: 901)]
Amino Acid sequence
[QGQSGQG][NLCTEHSFALDCRSYGGGSSGGSISSGLLSGRSANPGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 902)

[spacer (SEQ ID NO: 645)][huCD71Lc_TF02_3012 VL domain (SEQ ID NO: 903)]
Amino Acid sequence
[QGQSGQG][NLCTEHSFALDCRSYGGGSSGGSAVGLLAPPGGLSGRSANPGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 904)

[spacer (SEQ ID NO: 645)][huCD71Lc_TF02_2013 VL domain (SEQ ID NO: 905)]
Amino Acid sequence
[QGQSGQG][NLCTEHSFALDCRSYGGGSSGGSISSGLLSGRSANIGGGSDIQMTQSPSSLSASVGDRVT
ITCSASSSVYYMYWFQQKPGKAPKLWIYSTSNLASGVPSRFSGSGSGTDYTLTISSMQPEDFATYYCQQR
RNYPYTFGQGTKLEIK] (SEQ ID NO: 906)

[spacer (SEQ ID NO: 645)][huCD71Lc_TF02_3013 VL domain (SEQ ID NO: 907)]
Amino Acid sequence
[QGQSGQG][NLCTEHSFALDCRSYGGGSSGGSAVGLLAPPGGLSGRSANIGGSDIQMTQSPSSLSASVG
DRVTITCSASSSVYYMYWFQQKPGKAPKLWIYSTSNLASGVPSRFSGSGSGTDYTLTISSMQPEDFATYY
CQQRRNYPYTFGQGTKLEIK] (SEQ ID NO: 908)

Example 3

Generation and Characterization of Activatable Anti-CD71 Antibodies

The studies provided herein were designed to generate activatable anti-CD71 antibodies of the disclosure.

Anti-CD71 activatable antibodies were generated with different masking efficiencies (i.e., a measurement of the ability of the MM of the activatable antibody to block binding of the AB of the activatable antibody to its target). The peptides TF01 and TF02 were mutated by truncation and alanine scanning as described in Example 2, and these masking peptide variants were used to generate families of anti-CD71 activatable antibodies of the present disclosure with a range of masking efficiencies.

Figure 2:
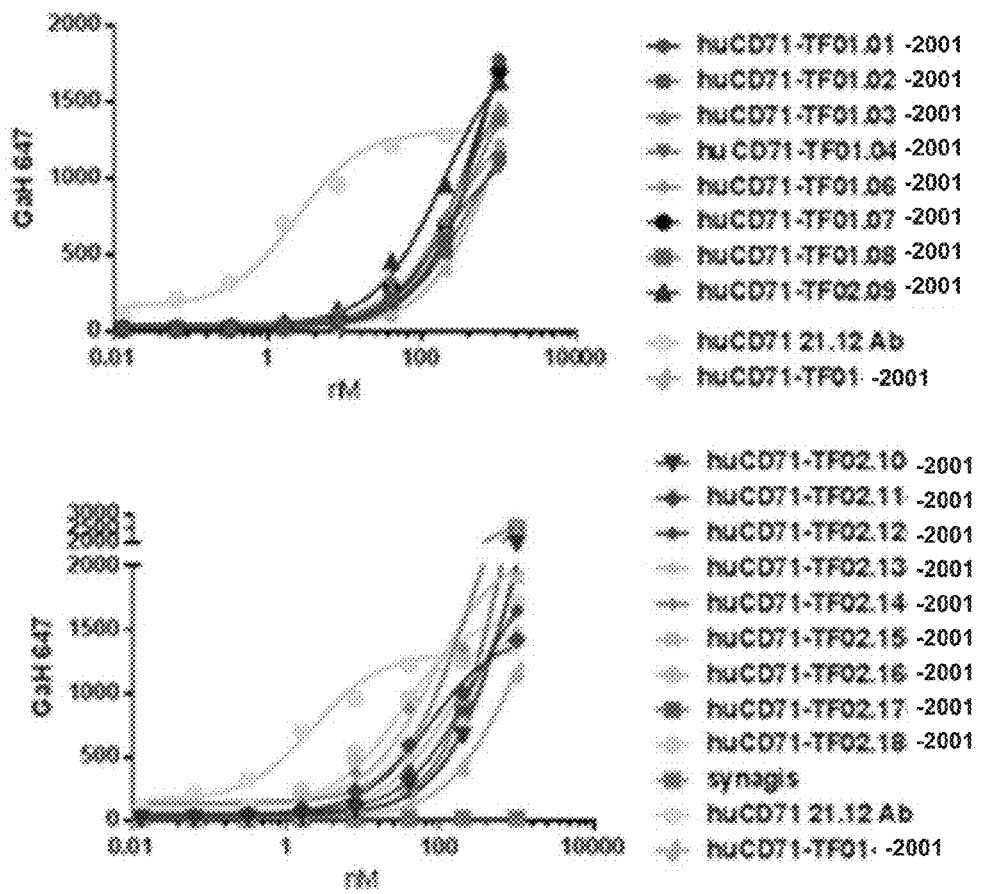
FIG. 2 is a graph depicting the ability of various activatable anti-CD71 antibodies of the disclosure to bind human CD71.

Binding of anti-CD71 activatable antibodies of the present disclosure to the NCI H292 (also referred to herein as H292) cell line was evaluated using FACS. Briefly, cells were labeled with huCD71 antibody or activatable antibody at the indicated concentrations and subsequently detected with an Alexa Fluor 647 labeled goat anti-human IgG secondary antibody. As shown in FIG. 2, anti-CD71 activatable antibodies of the present disclosure show a range of masking efficiencies compared to the parental anti-CD71 antibody (huCD71 21.12 Ab).

Figure 3A:
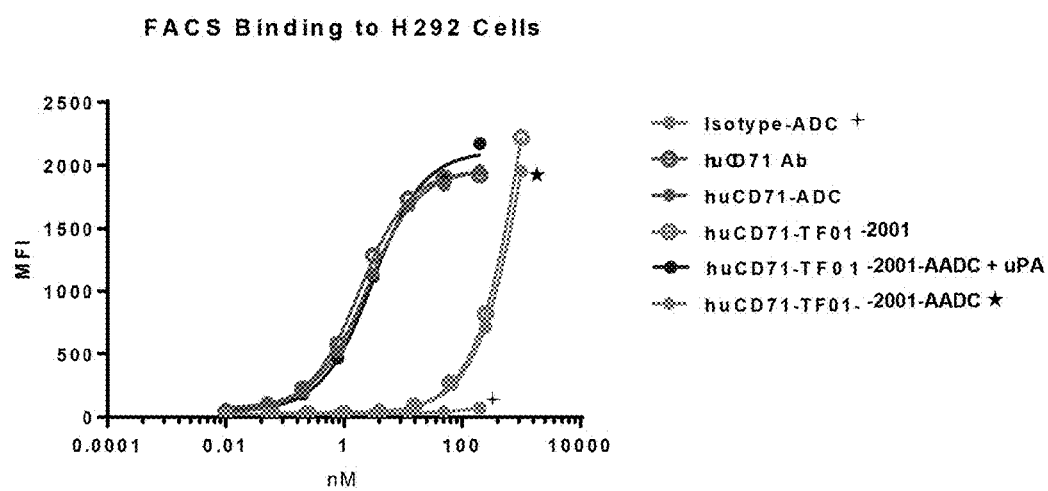
FIG. 3A is a graph depicting the ability of unconjugated and conjugated anti-CD71 activatable antibodies of the disclosure to bind human CD71 when the activatable antibody is intact or proteolytically activated.
Figure 3B:
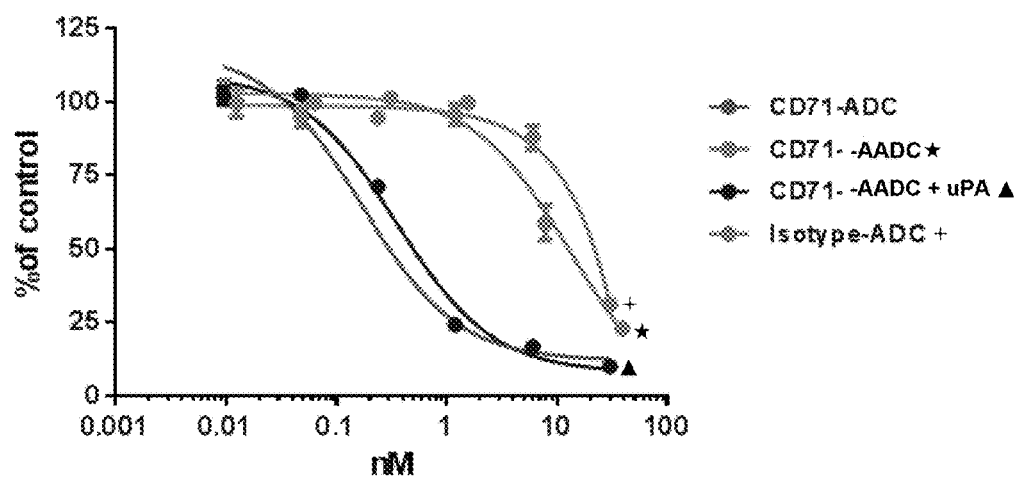
FIG. 3B is a graph depicting the in vitro cytotoxicity of conjugated anti-CD71 activatable antibodies and activated conjugated anti-CD71 activatable antibodies of the disclosure.

As shown in FIG. 3A, huCD71 activatable antibody drug conjugates of the present disclosure behave similarly to un-conjugated activatable antibodies and recover huCD71 antibody binding activity upon proteolytic activation. This study was done using the activatable anti-CD71 antibody referred to herein as huCD71 TF01-2001 conjugated to MMAD via a val-cit linker (the linker-toxin is referred to herein as vc-MMAD), and this activatable antibody construct includes the VH of SEQ ID NO: 5, the VL of SEQ ID NO: 7, the MM of SEQ ID NO: 16, and the CM comprising the sequence ISSGLLSGRSDNH (SEQ ID NO: 406). The binding of uPA treated or intact huCD71 TF01-2001 activatable antibody -MMAD conjugated to H292 cells was evaluated by FACS using a standard FACS labeling protocol. An anti-CD71 activatable antibody drug conjugate, also referred to herein as "AADC," was activated by an overnight incubation with uPA. FIG. 3B shows the ability of activated anti-CD71 activatable antibody huCD71 TF01-2001 conjugated to MMAD via a val-cit linker (the linker-toxin is referred to herein as v-MMAD or vc-MMAD), to kill cells in vitro in a manner similar to anti-CD71 antibody 21.12-MMAD. Similar results were observed when an activatable antibody of the embodiments conjugated to a nucleic acid damaging agent was tested in such cell killing assays.

Figure 4:
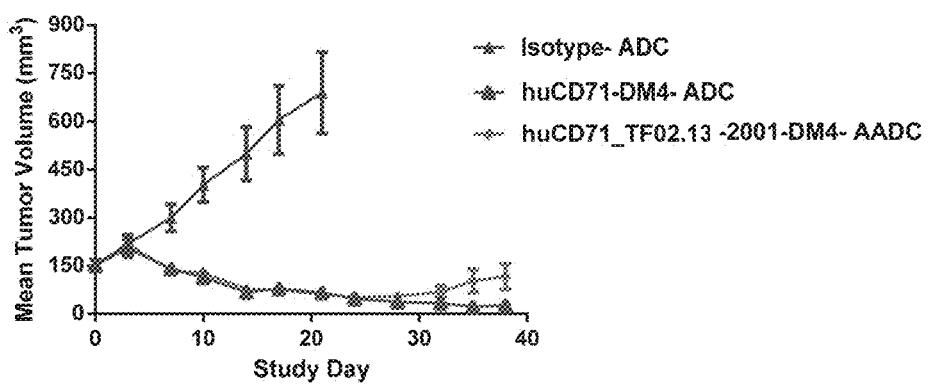
FIG. 4 is a graph depicting the efficacy of a conjugated activatable anti-CD71 antibody of the disclosure in NCI-H292 xenograft tumors.

H292 xenograft tumors treated with isotype-DM4 control, huCD71-DM4 ADC, and the conjugated anti-CD71 activatable antibody huCD71 TF02.13_2001-DM4 AADC, which has the VH of SEQ ID NO: 5, the VL of SEQ ID NO: 7, the MM of SEQ ID NO: 309 (NLCTEHSAALDCRSY), and the CM comprising the sequence ISSGLLSGRSDNH (SEQ ID NO: 406). Tumors were grown to an average of 150 mm$^3$; then the mice were randomized into groups of eight and dosed on day 0 and 7 with the indicated test articles. The results of this study are shown in FIG. 4. Mean tumor volume±SEM for each group is plotted. Both the ADC and AADC induce tumor regressions. All DM4-conjugated activatable antibodies disclosed herein were produced by TCRS (The Chemistry Research Solution).

Figure 5:
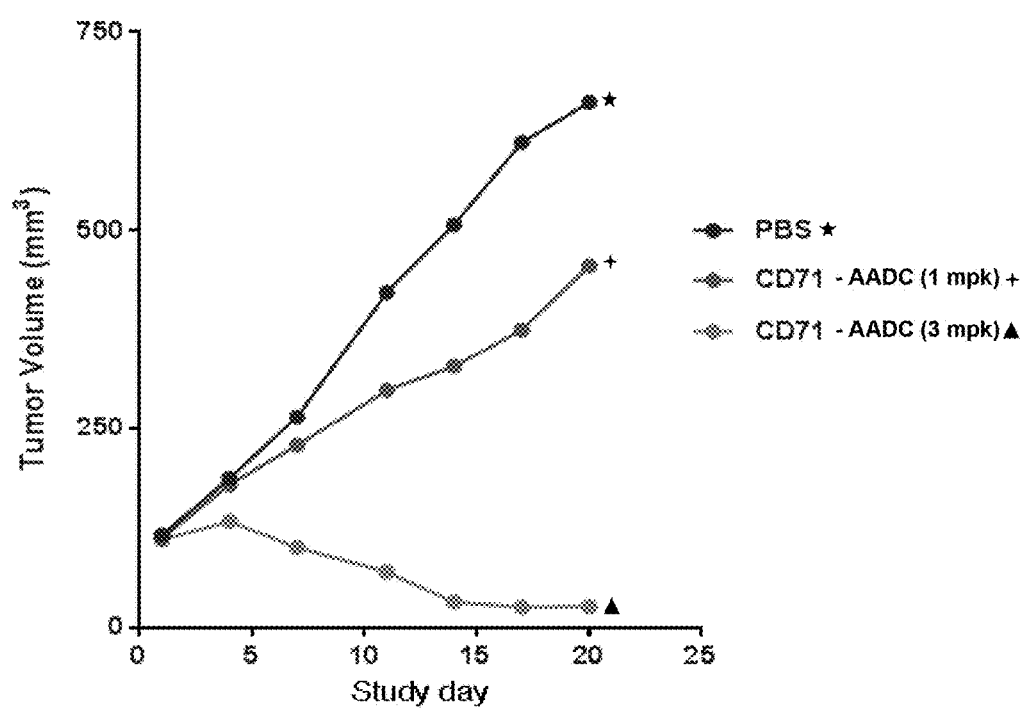
FIG. 5 is a graph depicting the efficacy of a conjugated activatable anti-CD71 antibody of the disclosure in breast cancer HCC1806 xenograft tumors.

FIG. 5 is a graph depicting the results of breast cancer HCC1806 xenograft tumors treated with PBS as a control and with two different doses, 1 mg/kg and 3 mg/kg, of the conjugated activatable anti-CD71 antibody huCD71 TF02.13-2001-DM4 AADC, which has the VH of SEQ ID NO: 5, the VL of SEQ ID NO: 7, the MM of SEQ ID NO: 309 (NLCTEHSAALDCRSY), and the CM1 comprising the sequence ISSGLLSGRSDNH (SEQ ID NO: 406). Mean tumor volume±SEM for each group is plotted. FIG. 5 demonstrates that the conjugated activatable anti-CD71 antibodies of the disclosure induce complete tumor regressions in breast HCC1806 xenograft tumors at lower than clinically relevant doses.

Figure 6A:
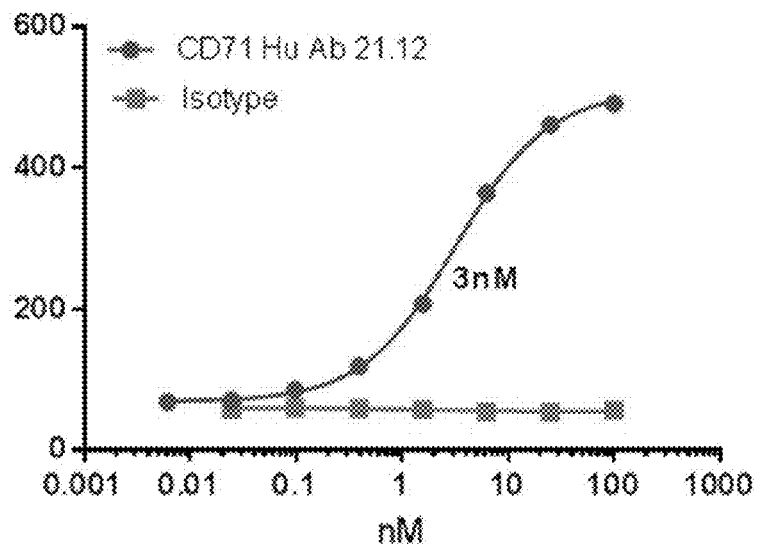
FIG. 6A is a graph depicting that an anti-CD71 antibody of the disclosure binds to cynomolgus monkey primary kidney epithelial cells.

FIG. 6A is a graph depicting the ability of the anti-CD71 antibody of the present disclosure (VH of SEQ ID NO: 5 and the VL of SEQ ID NO: 7) to bind cynomolgus monkey primary kidney epithelial cells, with an observed Kd of about 3 nM in this exemplary study. In this study, the binding of the antibody of the present disclosure to the cells were performed using a standard FACS labelling method. Briefly, cells were labeled with the anti-CD71 antibody or isotype (palivizumab) control of the present disclosure at the indicated concentrations and subsequently detected with an Alexa Fluor 647 labeled goat anti-human IgG secondary antibody.

Figure 6B:
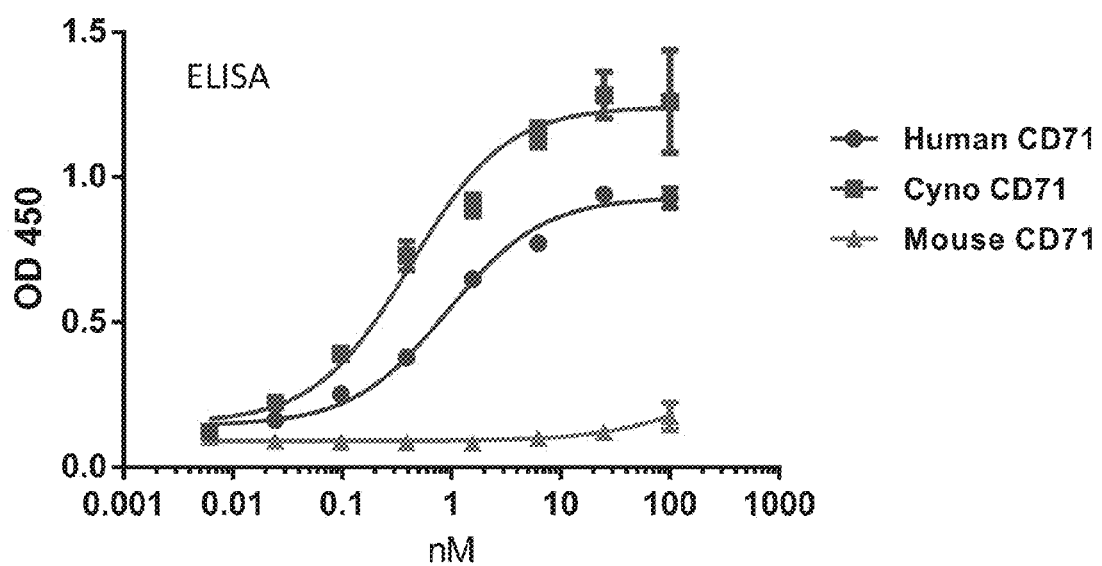
FIG. 6B is a graph depicting that the anti-CD71 antibody of the disclosure binds to cynomolgus monkey CD71 but does not bind to mouse CD71.

FIG. 6B demonstrates that the anti-CD71 antibody huCD71 (VH of SEQ ID NO: 5 and the VL of SEQ ID NO: 7) binds to human and cynomolgus monkey CD71 but does not bind to mouse CD71. In this assay, recombinant CD71 of the indicated type (1 µg/mL) was absorbed to ELISA plates and subsequently incubated with the anti-human CD71 21.12 antibody at the indicated concentration, followed and subsequently detected with goat anti-human IgG-HRP secondary antibody and Ultra TMB (Thermo Fisher Scientific) detection using an assay and in accordance with methods known to those skilled in the art.

FIG. 6C is a graph depicting the ability of the murine anti-CD71 antibody muM21 ("CD71 ms Ab") of the present disclosure (VH of SEQ ID NO: 1 and the VL of SEQ ID NO: 2) and the humanized anti-CD71 antibody Ab21.12 ("CD71 Hu Ab") of the present disclosure (VH of SEQ ID NO: 5 and the VL of SEQ ID NO: 7) to bind the human pancreatic cancer-derived BxPC3 cell line, both with an observed Kd of about 3 nM in this exemplary study. In this study, the binding of the antibodies of the present disclosure to the cells were performed using a standard FACS labelling method. Briefly, cells were labeled with the anti-CD71 antibody or human IgG1 isotype control antibody (palivizumab, "Isotype") of the present disclosure at the indicated concentrations and subsequently detected with an Alexa Fluor 647 labeled goat anti-human or goat anti-mouse IgG secondary antibody.

Figure 7:
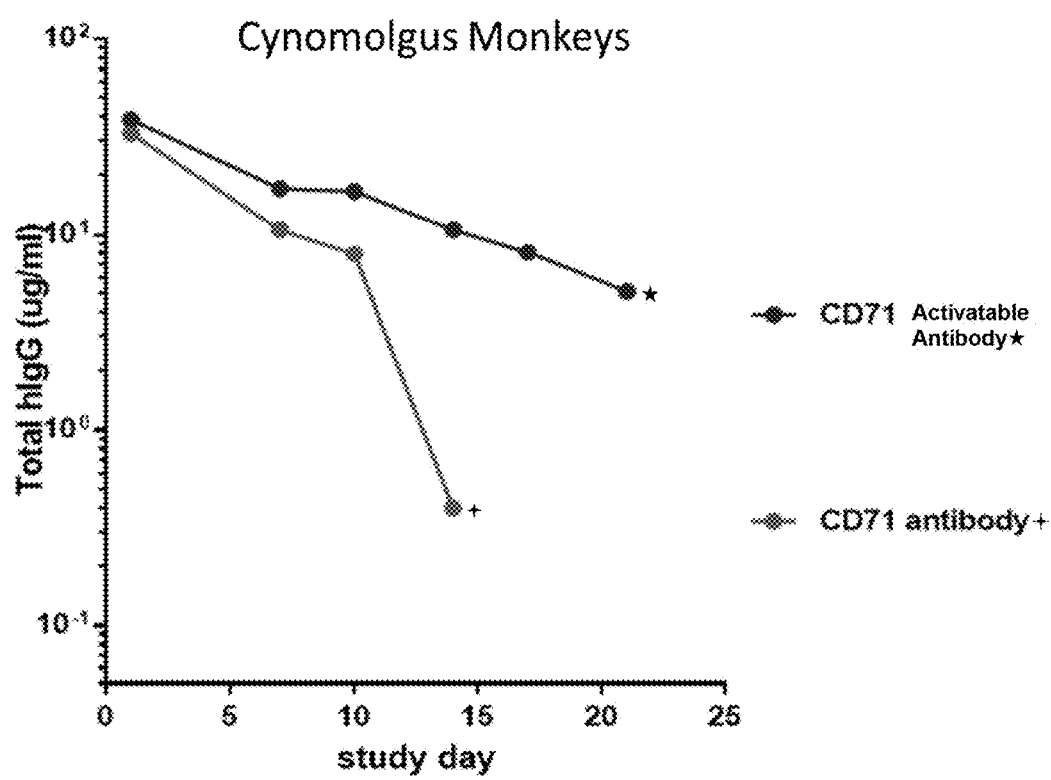
FIG. 7 is a graph depicting that a single dose of an activatable anti-CD71 antibody of the disclosure demonstrates a prolonged half-life compared to the CD71 parental antibody in cynomolgus monkeys.

FIG. 7 is a graph depicting that a single dose of an anti-CD71 activatable antibody of the present disclosure demonstrates a prolonged half-life compared to the CD71 parental antibody when administered to cynomolgus monkeys. In this study, monkeys were injected with a single dose on day 0 at 5 mg/kg of the indicated antibody, where the "CD71 antibody" was anti-human CD71 21.12 antibody of the present disclosure, and the "CD71 activatable antibody" was anti-human CD71 TF01.2001 activatable antibody of the present disclosure. The amount of total human IgG in the serum of each monkey was assayed on the indicated days using an anti-human IgG sandwich ELISA.

Figure 8:
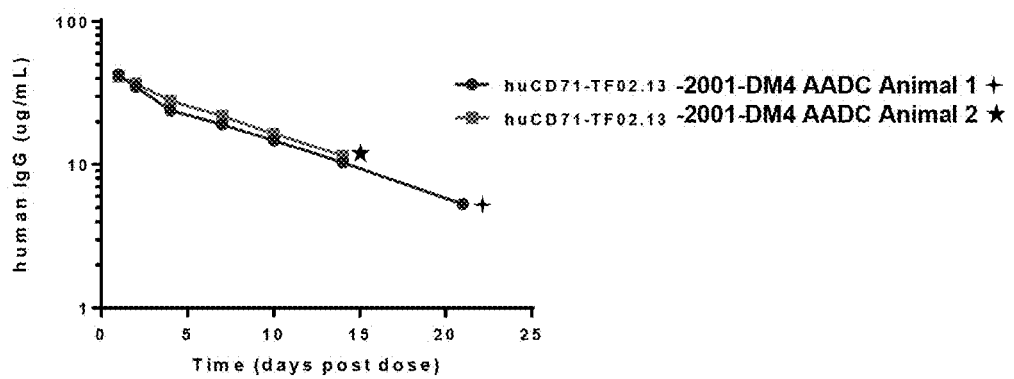
FIG. 8 is a graph depicting the pharmacokinetics of a conjugated activatable anti-CD71 antibody of the disclosure when administered to cynomolgus monkeys.

The pharmacokinetics and tolerability of the huCD71 TF02.13-2001 DM4 drug conjugate in two cynomolgus monkeys was evaluated after a single 5 mg/kg dose (FIG. 8). Total serum levels of human IgG were measured using an anti-human IgG sandwich ELISA.

Figure 9:
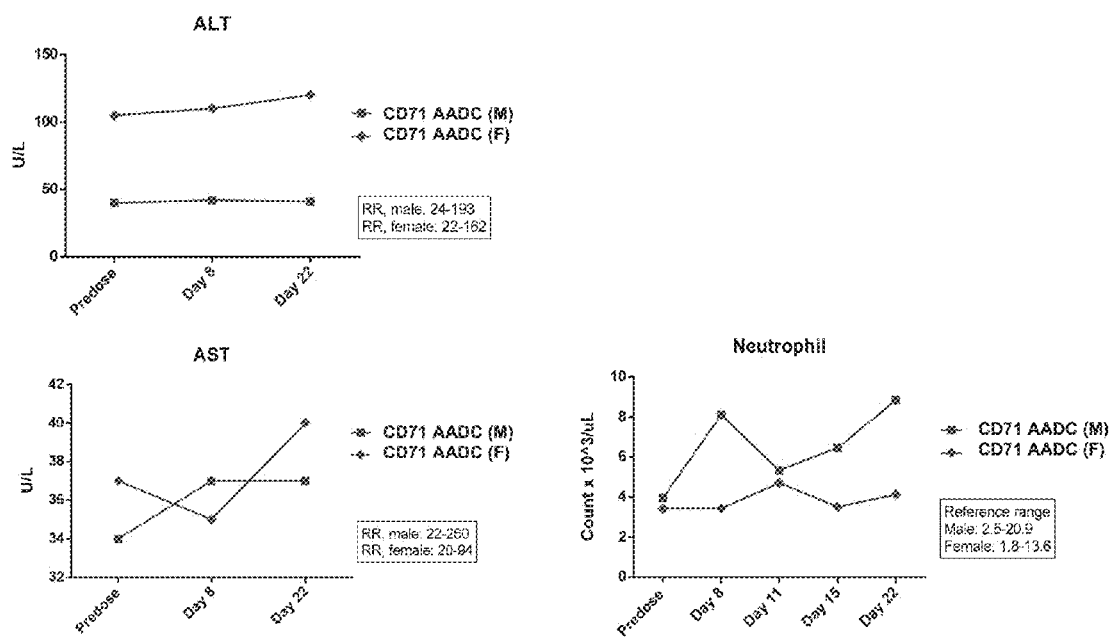
FIG. 9 is a graph depicting the tolerability of a conjugated activatable anti-CD71 antibody of the disclosure when administered to cynomolgus monkeys.

The studies depicted in FIGS. 7, 8, and 9 were conducted as part of a 3 week tolerability study (non-terminal); single dose n=2. The prolonged PK of intact activatable antibody that was observed was consistent with a decrease in normal tissue binding. Low circulating levels of activated conjugated activatable antibody were detected. The conjugated activatable antibody was well tolerated at 5 mg/mg. No evidence of on or off-target toxicity was observed. There were no clinical signs, weight loss, clinical chemistry or hematologic findings.

FIG. 9 shows that two cynomolgus monkeys that received the conjugated activatable anti-CD71 antibody of the disclosure (anti-huCD71 TF02.13-2001 DM4) showed no evidence of neutropenia (based on neutrophil counts) or liver toxicity (based on levels of alanine transaminase (ALT) or aspartate transaminase (AST)).

Example 4

Characterization of the Binding and Inhibitory Activity of the CD71 Antibody

This Example shows the ability of an anti-CD71 antibody of the present disclosure to inhibit binding of recombinant CD71 to its ligand, transferrin.

Figure 10:
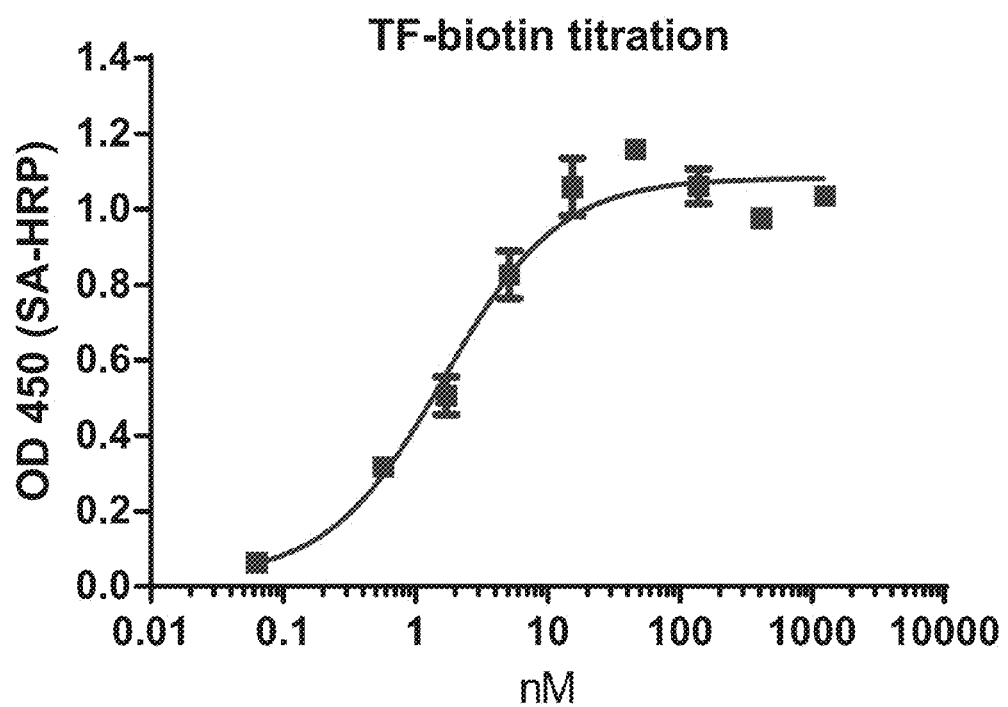
FIG. 10 is a graph depicting an exemplary assay of the binding between recombinant CD71 and its ligand transferrin.

FIG. 10 shows the binding of recombinant human transferrin (Tf) ligand to recombinant human CD71 in the absence of anti-CD71 antibody using a solid-phase ELISA binding assay. In this study, a dissociation constant ($K_d$) of about 1.6 nM of transferrin for human CD71 was determined in this example. In this assay, recombinant human CD71 (1 µg/ml) was absorbed to ELISA plates and subsequently incubated with the indicated concentration of biotinylated transferrin ligand, followed by detection of bound biotinylated transferrin using streptavidin-horse radish peroxidase (HRP) and Ultra TMB detection (Thermo Fisher Scientific) using an assay and in accordance with methods known to those skilled in the art.

Figure 11A:
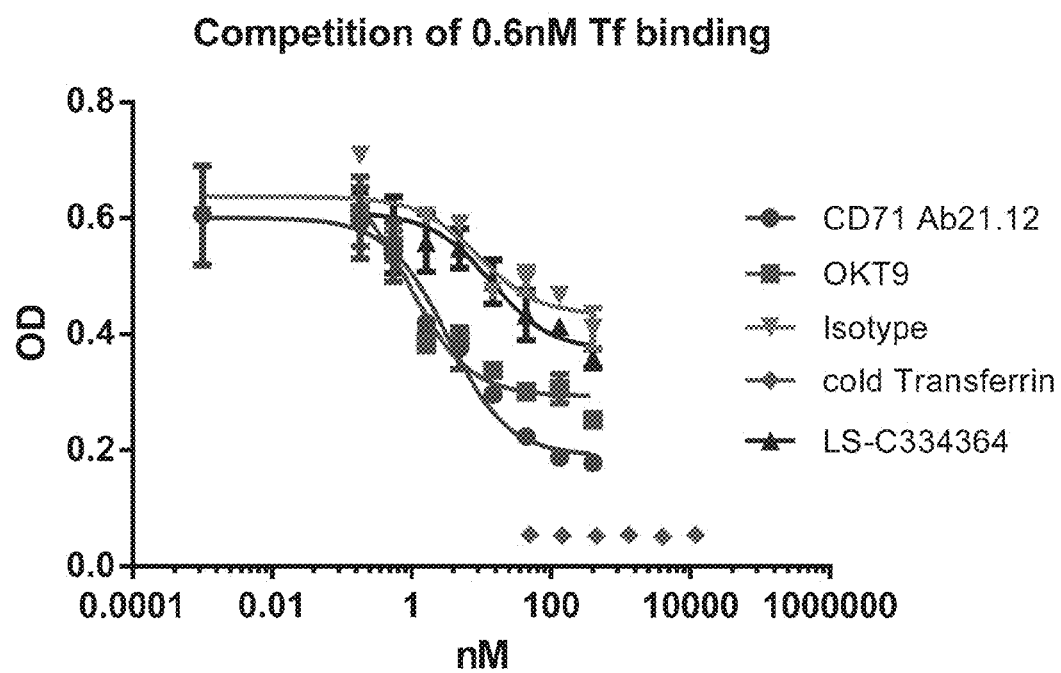
FIG. 11A is a graph depicting a competitive binding assay to CD71 between an anti-CD71 antibody of the present disclosure and transferrin.

FIG. 11A shows the effect on binding between recombinant human transferrin (Tf) ligand and recombinant human CD71 under various conditions using a solid-phase ELISA binding assay, including binding in the presence of an anti-CD71 antibody of the present disclosure. In particular as shown in FIG. 11A, this study showed that a humanized anti-CD71 antibody of the present disclosure ("CD71 Ab21.12") inhibited the binding between the transferrin ligand and its CD71 receptor as compared to an isotype control. The results also showed that this inhibition was similar to the binding inhibition demonstrated by a different, commercially-available mouse anti-human CD71 monoclonal antibody ("OKT9"). The results also showed that neither a commercially-available rabbit anti-human CD71 polyclonal antibody (LS-C334364, LS Bio) nor an isotype control significantly inhibited transferrin binding to CD71, and that binding activity was abolished by the addition of an excess amount of cold transferrin. In this assay, recombinant human CD71 protein (1 µg/ml) was absorbed to ELISA plates and subsequently incubated with 0.6 nM of biotinylated-transferrin in the presence of the indicated concentrations of antibody or transferrin (where the anti-CD71 21.12 of the present disclosure having VH of SEQ ID NO: 5 and VL of SEQ ID NO: 7) as part of a titration assay. The bound transferrin was detected with streptavidin-conjugated HRP and Ultra TMB detection using an assay and in accordance with methods known to those skilled in the art.

Figure 11B:
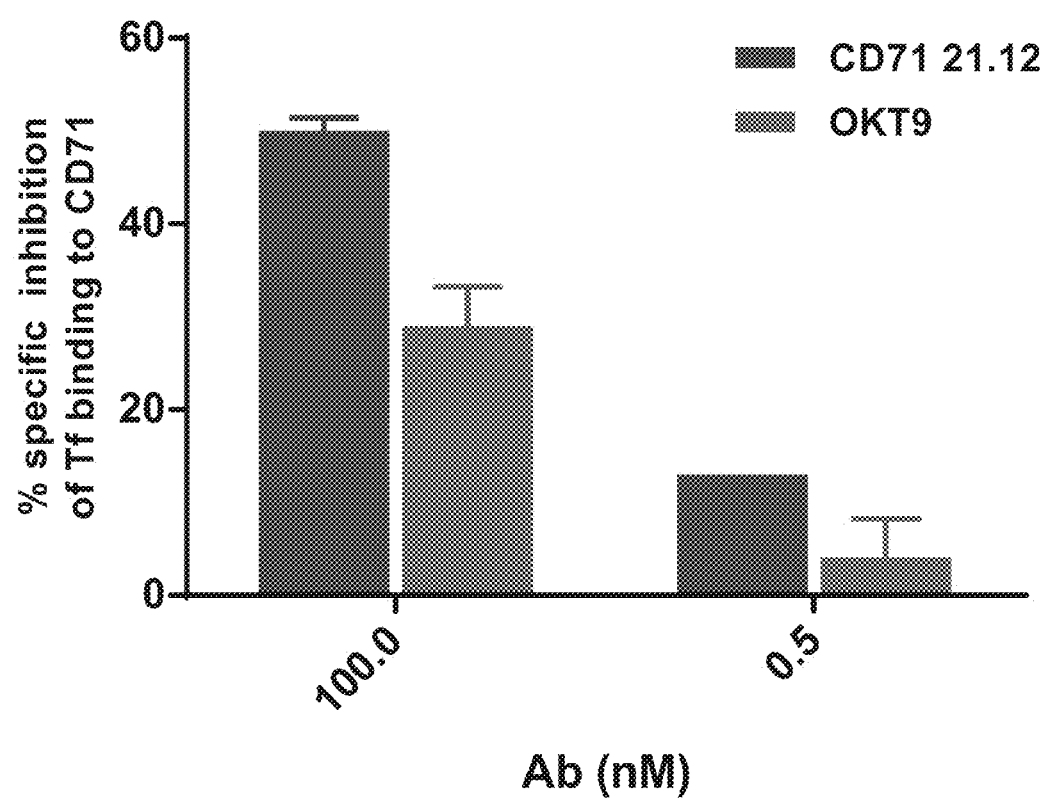
FIG. 11B is a graph depicting a binding assay of the binding of transferrin to CD71 demonstrating the inhibition of the binding by an anti-CD71 antibody of the present disclosure.

FIG. 11B shows the extent of inhibition of transferrin binding to CD71 by a known anti-CD71 monoclonal antibody (OKT9) is significantly less than that of the extent of inhibition by anti-CD71 21.12 antibody of the present disclosure. In this assay, recombinant human CD71 protein (1 µg/ml) was absorbed to ELISA plates and subsequently incubated with 0.6 nM of biotinylated-transferrin in the presence of the indicated concentrations of OKT9 anti-CD71 antibody or anti-CD71 21.12 antibody of the present disclosure (anti-CD71 21.12 having VH of SEQ ID NO: 5 and VL of SEQ ID NO: 7) as part of a titration assay. The bound transferrin was detected with streptavidin-conjugated HRP and Ultra TMB detection using an assay and in accordance with methods known to those skilled in the art.

Example 5

CD71 Expression in Multiple Primary and Metastatic Tumors

This Example shows that CD71 is expressed in a large variety of primary and metastatic tumor types by immunohistochemical (IHC) staining using an anti-CD71 antibody.

Figure 12A:
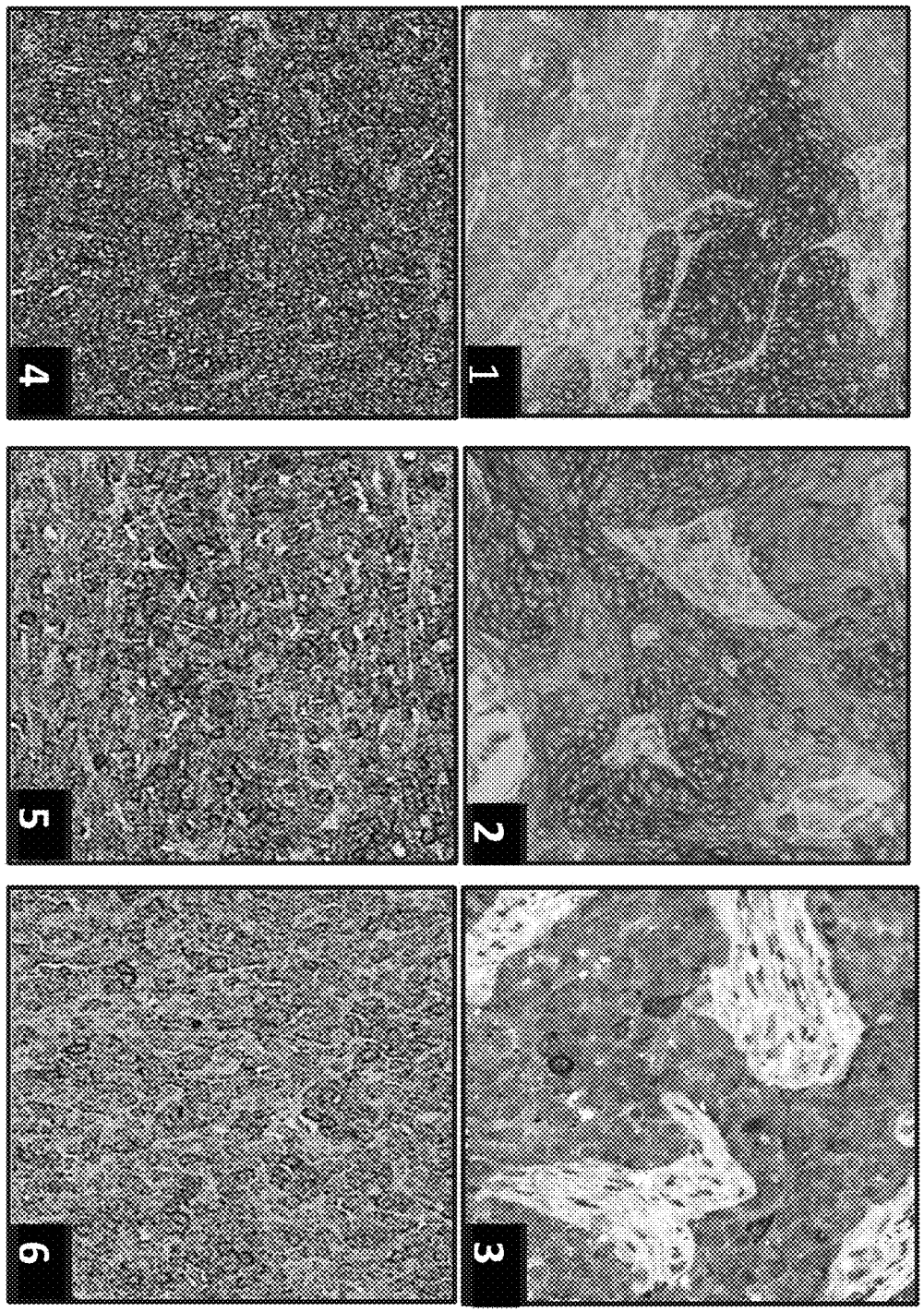
FIGS. 12A, 12B, and 12C depict exemplary immunohistochemical (IHC) assays to determine levels of CD71 expression in various primary and metastatic cancer tissue types.
Figure 12B:
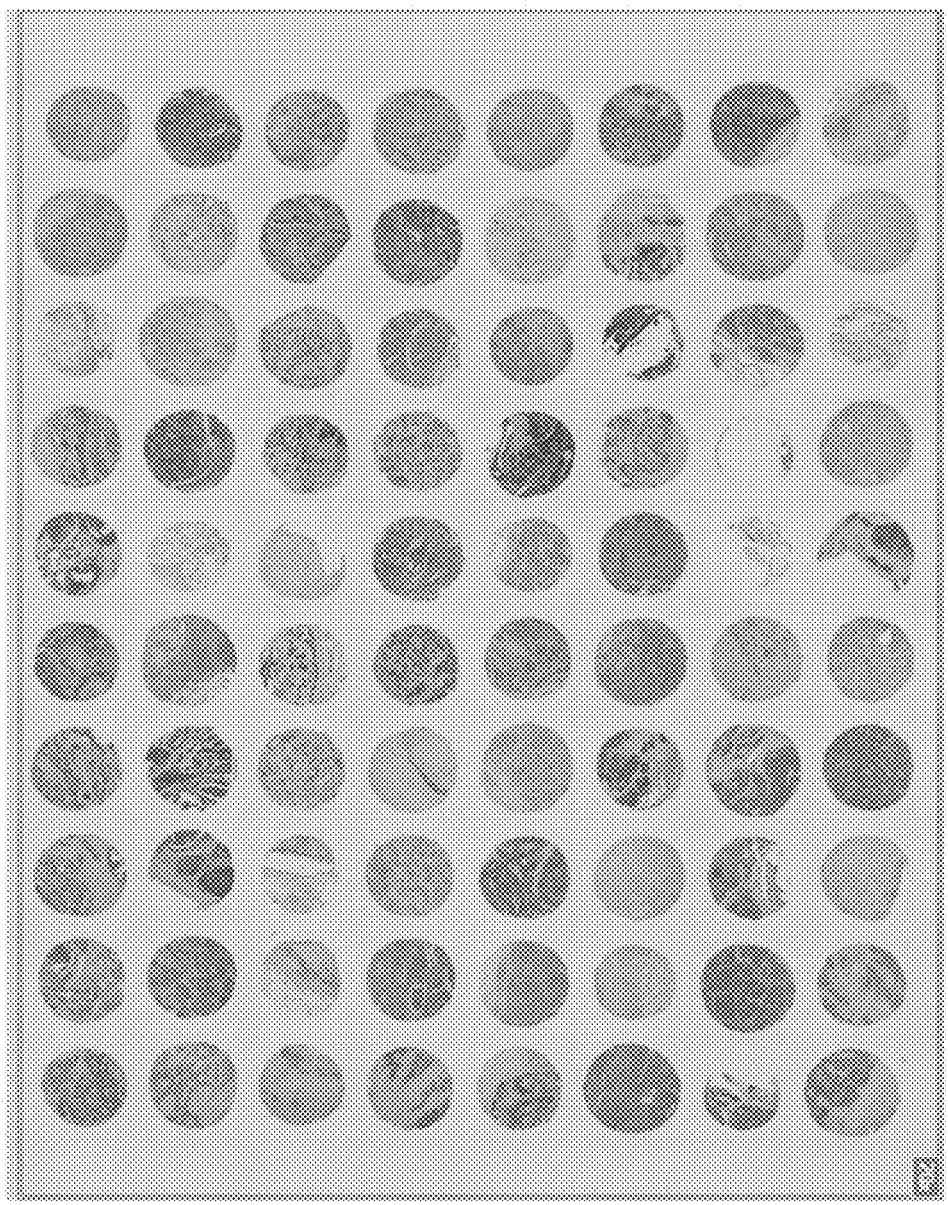
Figure 12C:
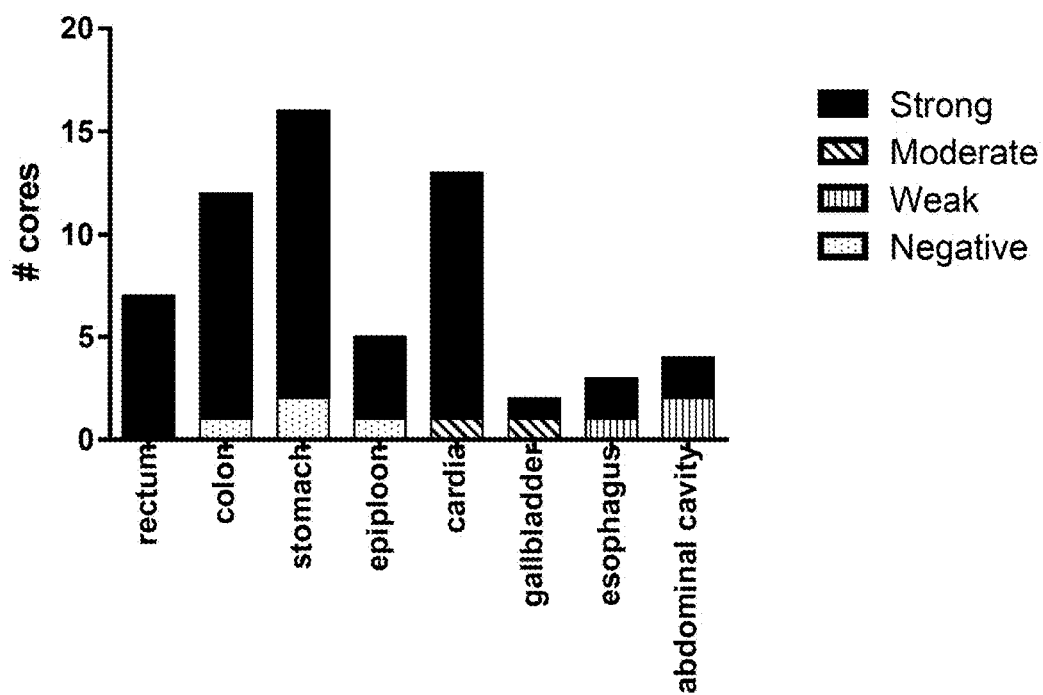

FIGS. 12A, 12B, and 12C show that CD71 is highly expressed in a large number of primary and metastatic tumor samples, using IHC staining with a commercially-purchased anti-CD71 antibody on multiple primary tumors and metastatic tissue microarrays (TMA). FIG. 12A shows an IHC staining of CD71 in cervical cancer (1), head and neck cancer (2), an H292 xenograft (3), non-Hodgkin's lymphoma (NHL) in lymph nodes (4), NHL in colon (5), and NHL in stomach (6). FIG. 12B shows an IHC staining of CD71 in a TMA consisting of cores from metastatic tumors demonstrated a moderate to high level of expression of CD71 in the majority of the cores. FIG. 12C shows a summary of the level of IHC staining of CD71 of one exemplary TMA shows that a large number of metastasis cores derived from multiple tissue sources showed a strong CD71 signal.

Example 6

Activatable Anti-CD71-AADC In Vivo Efficacy in Raji Xenograft Model

This Example shows that anti-human CD71 activatable antibodies with conjugated toxins (AADCs) of the present disclosure are efficacious in a non-Hodgkin's lymphoma (NHL) mouse xenograft model. These efficacies are specific to anti-human CD71 antibodies and are comparable or equivalent to the efficacy demonstrated by a parental anti-human CD71 drug conjugate.

Figure 13A:
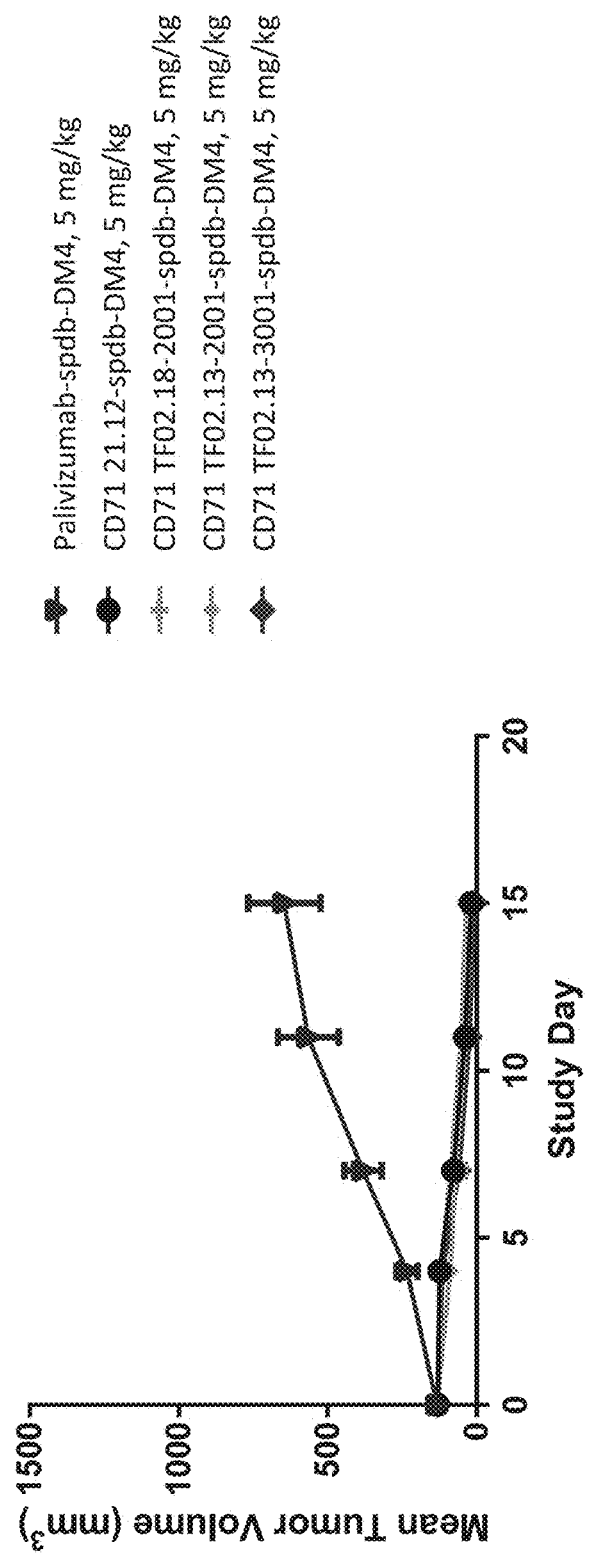
FIGS. 13A, 13B, and 13C depict exemplary efficacy studies of activatable anti-CD71 conjugated antibodies (AADCs) of the present disclosure using non-Hodgkin's lymphoma tumor xenografts in mice.

FIG. 13A shows the efficacy of various anti-CD71 activatable antibody drug conjugates in a mouse NHL xenograft model, where the activatable antibody drug conjugates of the present disclosure (CD71 TF02.18-2001-spdb-DM4, CD71 TF02.13-2001-spdb-DM4, and CD71 TF02.13.3001-spdb-DM4) showed significantly higher efficacy than an isotype control (palivizumab-spdb-DM4). The figure also shows that the activatable antibody drug conjugates of the present disclosure demonstrated an efficacy comparable to an unmasked anti-CD71 antibody drug conjugate (CD71 21.12-spdb-DM4). In this study, non-Hodgkin's lymphoma (NHL) Raji xenograft tumors in mice were grown to an average volume of 150 mm$^3$. The mice were then randomized into groups of eight and dosed on days 1 and 8 with 5 mg/kg of each indicated test article. The mean tumor volume±SEM was plotted for each time point.

Figure 13B:
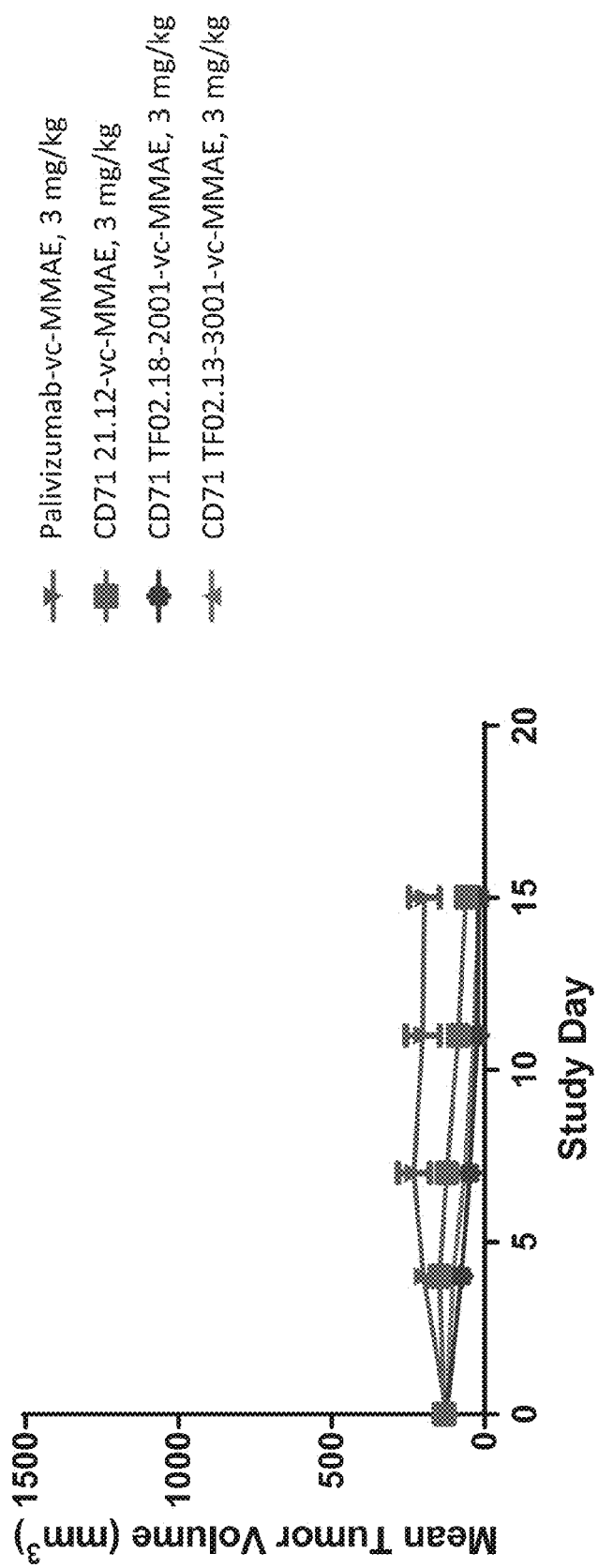

FIG. 13B shows the efficacy of various anti-CD71 activatable antibody drug conjugates in a mouse NHL xenograft model, where the activatable antibody drug conjugates of the present disclosure (CD71 TF02.18-2001-vc-MMAE and CD71 TF02.13-3001-vc-MMAE) showed significantly higher efficacy than an isotype control (palivizumab-vc-MMAE). The figure also shows that the activatable antibody drug conjugates of the present disclosure demonstrated an efficacy comparable to an unmasked anti-CD71 antibody drug conjugate (CD71 21.12-vc-MMAE). In this study, non-Hodgkin's lymphoma (NHL) Raji xenograft tumors in mice were grown to an average volume of 150 mm$^3$. The mice were then randomized into groups of eight and dosed on days 1 and 8 with 3 mg/kg of each indicated test article. The mean tumor volume±SEM was plotted for each time point.

Figure 13C:
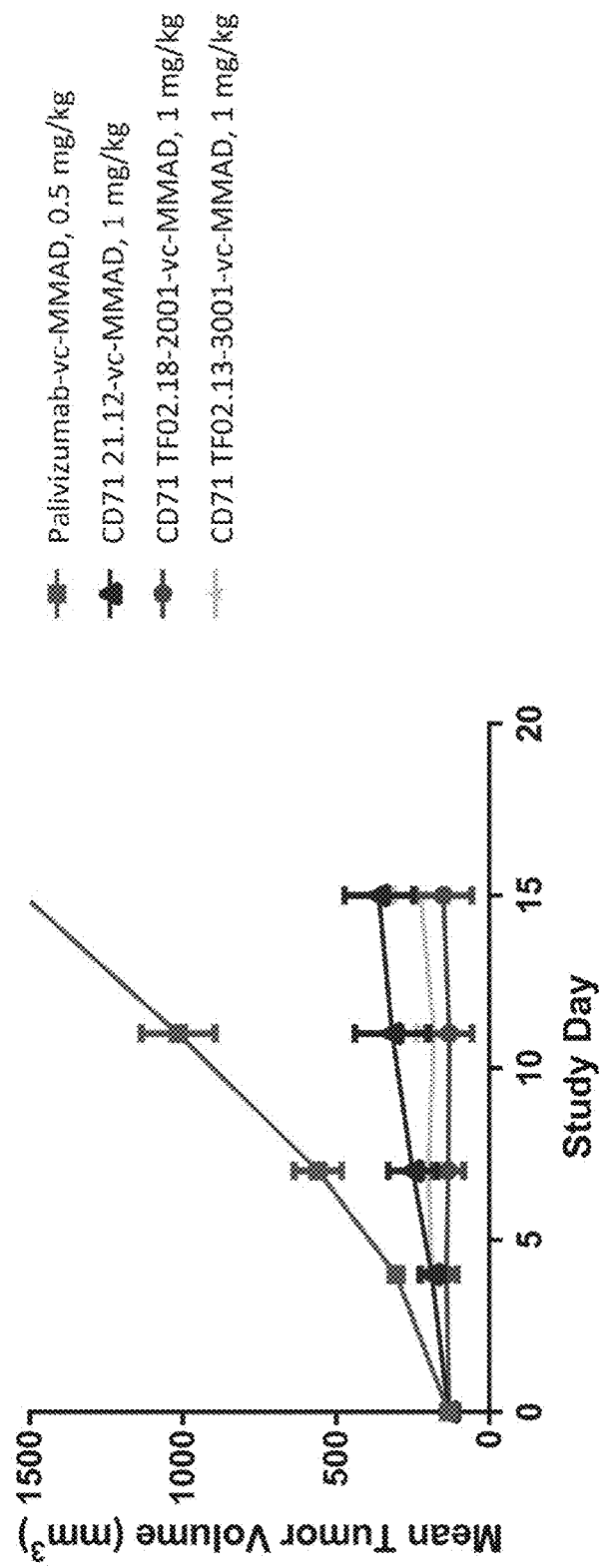

FIG. 13C shows the efficacy of various anti-CD71 activatable antibody drug conjugates in a mouse NHL xenograft model, where the activatable antibody drug conjugates of the present disclosure (CD71 TF02.18-2001-vc-MMAD and CD71 TF02.13-3001-vc-MMAD) showed significantly higher efficacy than an isotype control (palivizumab-vc-MMAD). The figure also shows that the activatable antibody drug conjugates of the present disclosure demonstrated an efficacy comparable to an unmasked anti-CD71 antibody drug conjugate (CD71 21.12-vc-MMAD). In this study, non-Hodgkin's lymphoma (NHL) Raji xenograft tumors in mice were grown to an average volume of 150 mm$^3$. The mice were then randomized into groups of eight and dosed on days 1 and 8 with 0.5 or 1 mg/kg of each indicated test article. The mean tumor volume±SEM was plotted for each time point.

Example 7

Cynomolgus Tolerability of Anti-CD71-ADC and Activatable-Anti-CD71-AADC

This Example shows that activatable anti-human CD71 antibodies with conjugated toxins (AADCs) of the present disclosure are well-tolerated in cynomolgus monkeys compared to the corresponding parental anti-CD71 ADCs based on one or more hematology readouts.

Figure 14F:
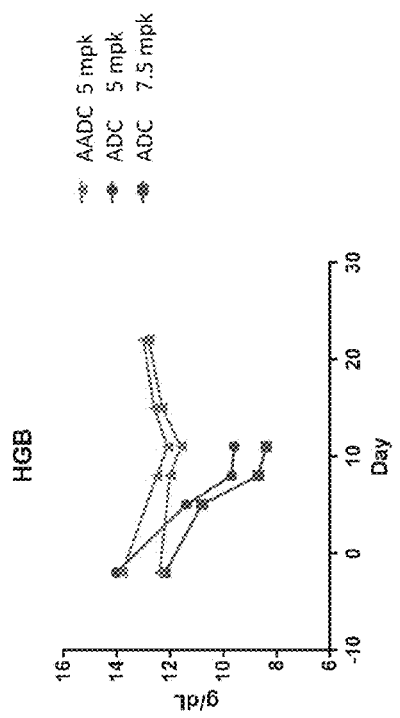
Figure 14E:
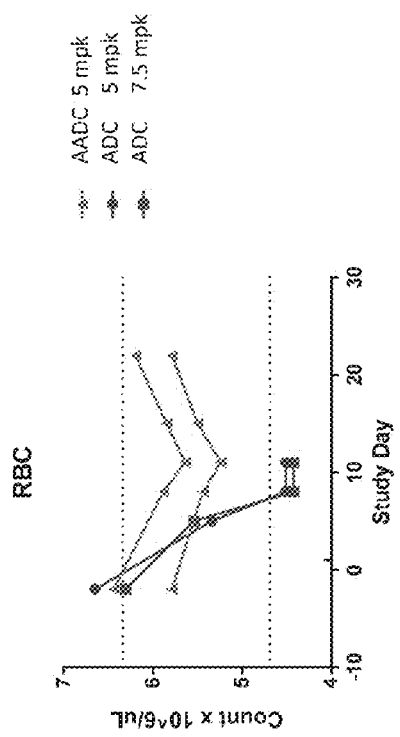
Figure 14G:
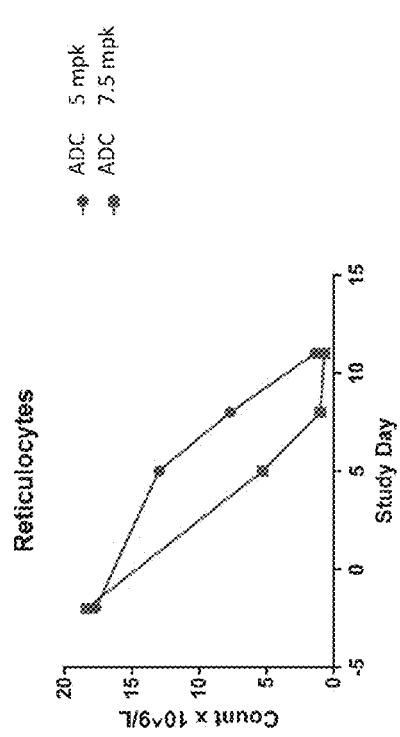

FIGS. 14A-14G show that anti-CD71 activatable antibody drug conjugates (AADCs) of the present disclosure demonstrate a higher tolerance in cynomolgus monkeys based on an absence of marked changes in each hematology readout, as compared to monkeys treated with high or low doses of the corresponding parental anti-CD71 ADC. The following hematology results were observed upon treatment of the monkeys with 5 mg/kg of the parental anti-CD71 ADC: a marked reduction in total white blood cells (WBC) with high dose ADC treatment (FIG. 14A), severe neutropenia by days 8 to 11 with high and low dose ADC treatment (FIG. 14B), a marked reduction in lymphocytes with high dose ADC treatment (FIG. 14C), decreased monocytes with both high and low dose ADC treatment, with monocyte recovery in the low-dose-treated animal on day 11 (FIG. 14D), decreased red blood cell count with both high and low dose ADC treatment (RBC) (FIG. 14E), a marked reduction of hemoglobin count (HGB) with both high and low dose ADC treatment (FIG. 14F), and a marked reduction of reticulocytes with both high and low dose ADC treatment (FIG. 14G). Monkeys treated with anti-CD71 ADC showed a normal platelet count (data not shown). In comparison, animals treated with activatable anti-CD71 AADCs of the present disclosure showed no marked changes in all of these hematological readouts (FIGS. 14A-14F). In this study, a single dose of activatable anti-CD71 TF02.13-2001-spdb-DM4 ("AADC") of the present disclosure having a drug-antibody ratio (DAR) of about 3.4 was dosed in cynomolgus monkeys at 5 mg/kg and anti-CD71 21.12-spdb-DM4 ("ADC") of the present disclosure was dosed at 5 mg/kg (low dose) and 7.5 mg/kg (high dose). The hematological results were obtained from each monkey at the indicated days of the study using techniques and methods known in the art.

Example 8

CD71 Expression and Sensitivity to Anti-CD71-Mediated Cytotoxicity in Multiple Cell Lines This Example shows that CD71 is expressed in high levels in many tumor-derived cell lines, and that many of these cell lines demonstrated sensitivity to anti-CD71-targeted cytotoxicity.

Figure 15:
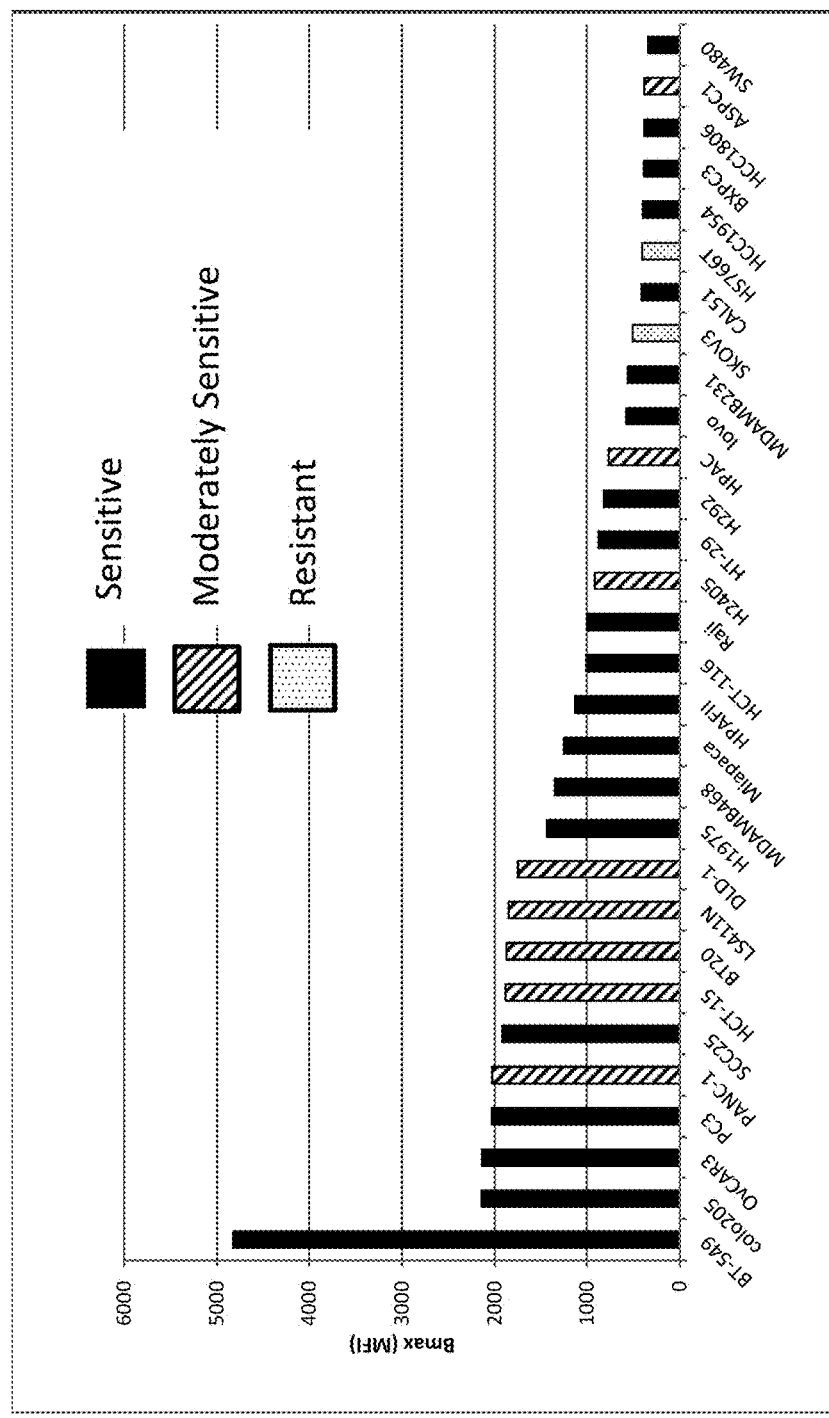
FIG. 15 depicts exemplary CD71 expression levels in various cell lines using an anti-CD71 antibody, as well as cytotoxicity studies in the same cell lines using an anti-CD71 antibody of the present disclosure with a drug-conjugated secondary antibody.

FIG. 15 shows the maximum binding or relative expression of CD71 in the indicated cell lines by FACS analysis. FACS staining was carried out using a commercially available anti-CD71 mouse monoclonal antibody, OKT9, followed by an Alexa Fluor 647conjugated goat anti mouse secondary antibody, with the height of the bar for a given cell line corresponding to the relative amount of CD71-derived signal for that cell line. The pattern of the bar (solid, striped, or dotted) for a given cell line shows the relative sensitivity of the corresponding cell line in an in vitro cytotoxicity assay where the cell line was treated with anti-CD71 21.12antibody of the present disclosure in the presence of an anti-human secondary antibody conjugated to MMAE toxin. A cell line was categorized as "sensitive" if cytotoxicity was observed with a less than 1 nM EC50. A cell line was categorized as "moderately sensitive" if maximum killing was less than 50% and EC50 was greater than 1 nM. A cell line was categorized as "resistant" if no to little cytotoxicity was observed.

Example 9

CD71 Expression on HT29, BxPc3, Fadu and MDA MB 231 Cell Lines

This Example shows that activatable anti-human CD71 antibodies of the present disclosure bind CD71 on multiple cell lines with a higher dissociation constant than that of the unmasked anti-human CD7 antibody of the present disclosure, thus showing the effect of the mask in reducing binding prior to activation.

FIGS. 16A to 16D shows the amount of binding of anti-CD71 activatable and parental antibodies of the present disclosure to the cell lines HT29 (FIG. 16A), BxPc3 (FIG. 16B), FaDu (FIG. 16C), and MDA MB 231 (FIG. 16D). In this study, the binding of the antibodies of the present disclosure to the indicated cell lines were performed using a standard FACS labelling method. Briefly, cells were labeled with the indicated antibodies of the present disclosure: anti-human CD71 antibody (anti-human CD71 Ab21.12 antibody, "CD71-Ab") or one of two anti-human CD71 activatable antibodies (anti-human CD71 TF02.13-3001, "CD71-ActAb 1," or anti-human CD71 TF02.18-2001, "CD71-ActAb 2") at the indicated concentrations and subsequently detected with an Alexa Fluor 647 labeled goat anti-human IgG secondary antibody. Table 14 below shows the equilibrium dissociation constants based on the binding curves depicted in FIGS. 14A to 14D. These results show that anti-human CD71 21.12 antibody (CD71-Ab) binds all cell lines with similar Kd (0.39 to 0.81 nM), while the binding of anti-human CD71 TF02.13-3001 (CD71-ActAb 1) and anti-human CD71 TF02.18-2001 (CD71-ActAb 2) to the cell lines were significantly shifted to the right (38 to 46 fold), which is indicative of the masking efficiency of the masking moiety.

TABLE 14

Exemplary Observed CD71 Binding Activity of Activatable Anti-CD71

| Cell Line | CD71-Ab Kd (nM) | CD71-ActAb 1 Kd (nM) | CD71-ActAb 1 ME* | CD71-ActAb 2 Kd (nM) | CD71-ActAb 2 ME* | Bmax (MFI) |
|---|---|---|---|---|---|---|
| FaDu | 0.39 | 14.74 | 38 | 15.36 | 39 | 1000 |
| HT29 | 0.51 | 23.02 | 45 | 19.74 | 39 | 700 |
| MB231 | 0.84 | 38.84 | 46 | 31.99 | 38 | 500 |
| BxPC3 | 0.81 | 35.18 | 43 | 36.35 | 43 | 400 |

*ME = masking efficiency

Example 10

Anti-CD71 ADC Cytotoxicity on HT29, BxPc3, FaDu and MDA MB 231 Cell Lines

This Example shows that anti-human CD71 antibody drug conjugates of the present disclosure demonstrate a higher cytotoxicity against multiple cell lines compared to an isotype control ADC.

Figure 17A:
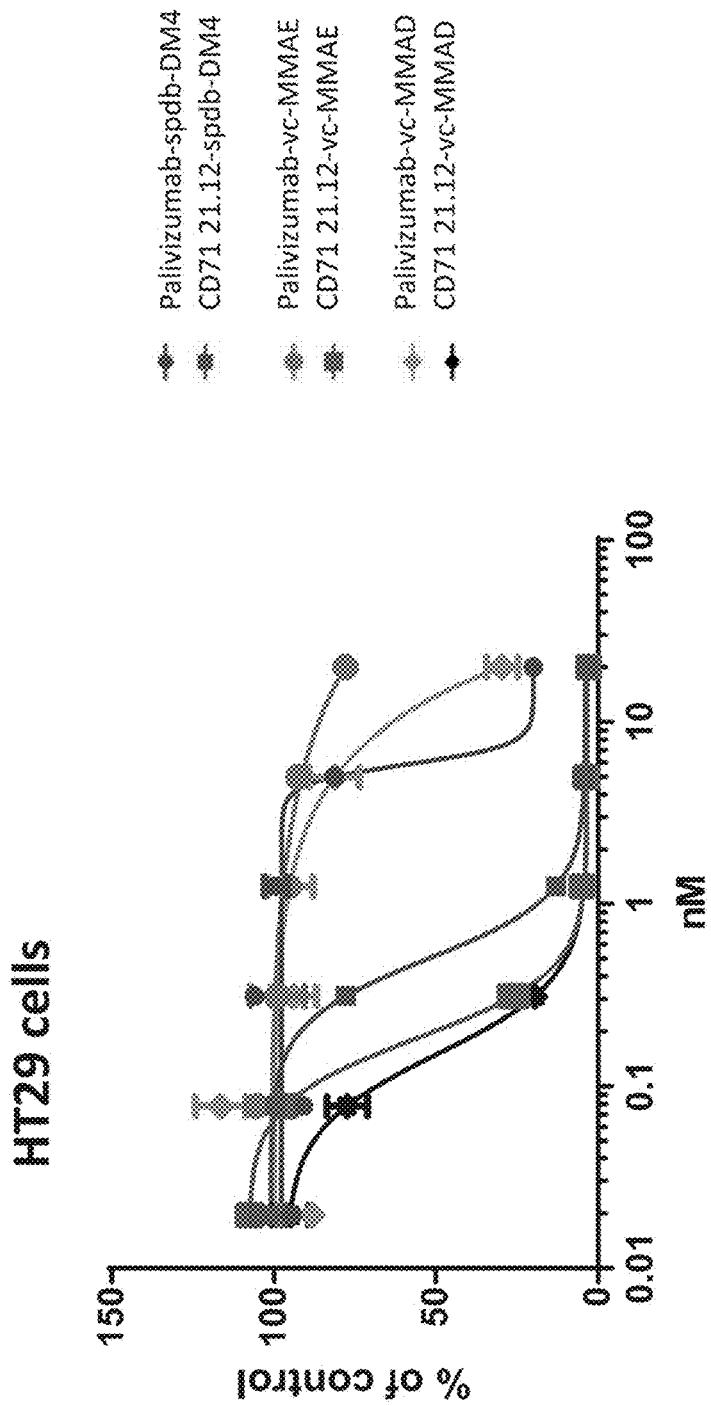
FIGS. 17A to 17D depict exemplary studies of the cytotoxicity of anti-CD71 antibody drug conjugates of the present disclosure on various cell lines.
Figure 17B:
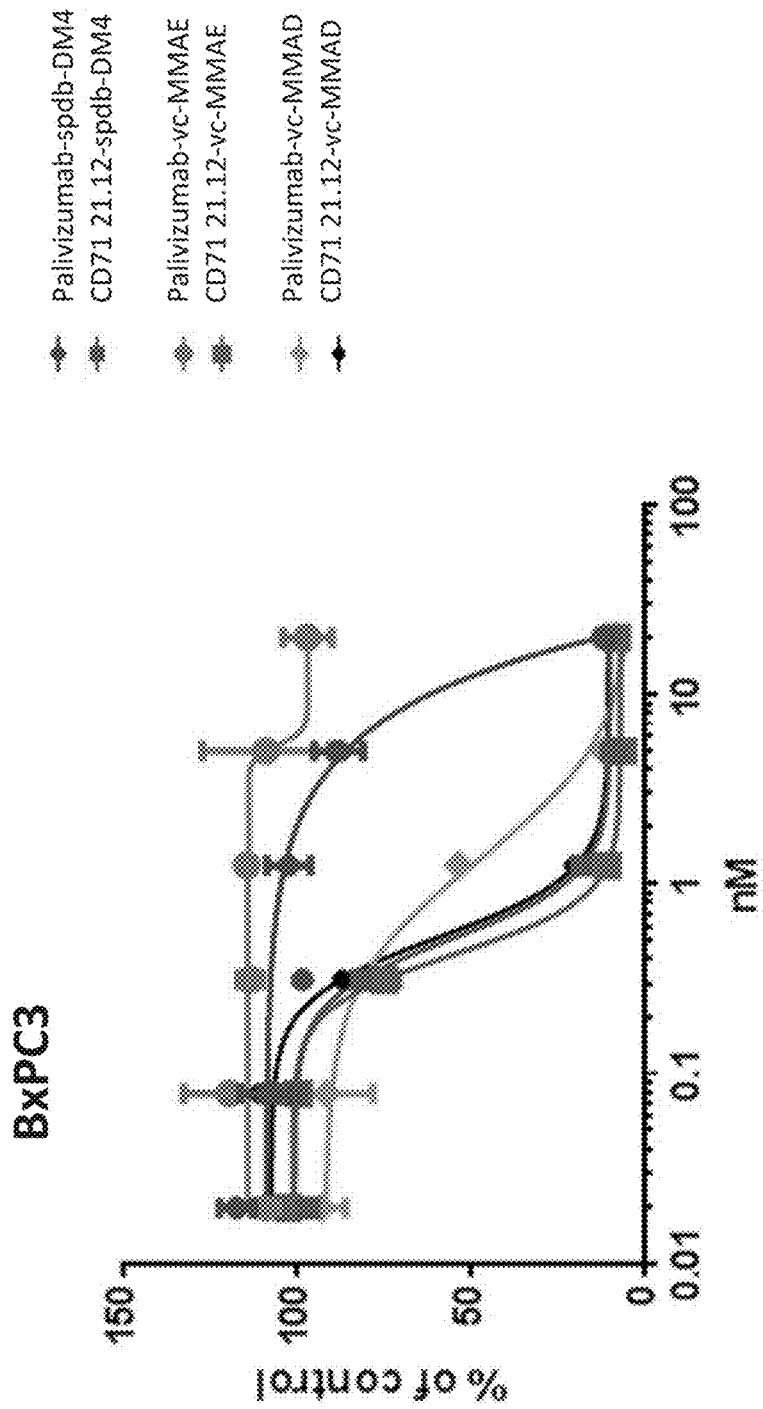
Figure 17C:
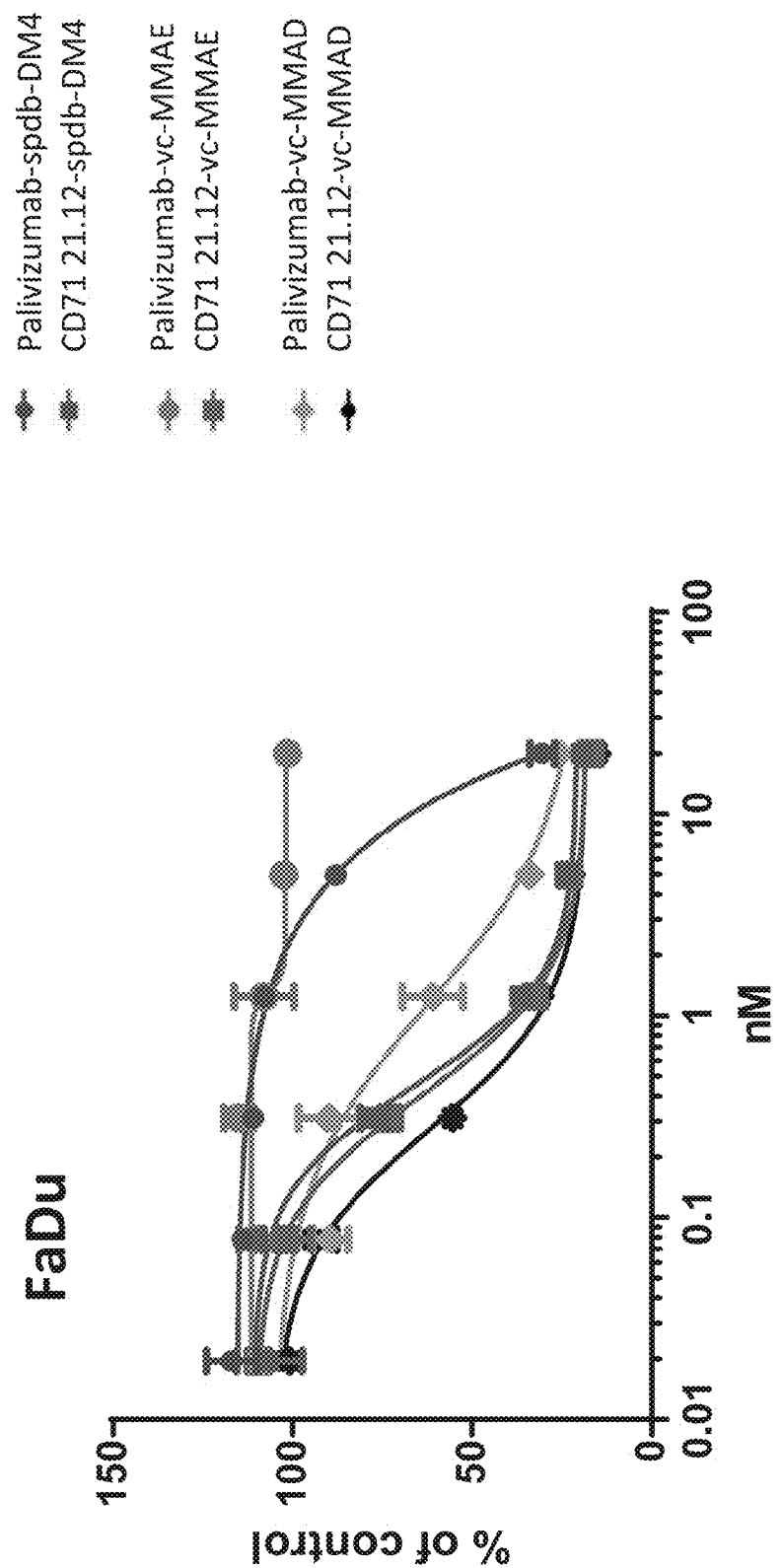
Figure 17D:
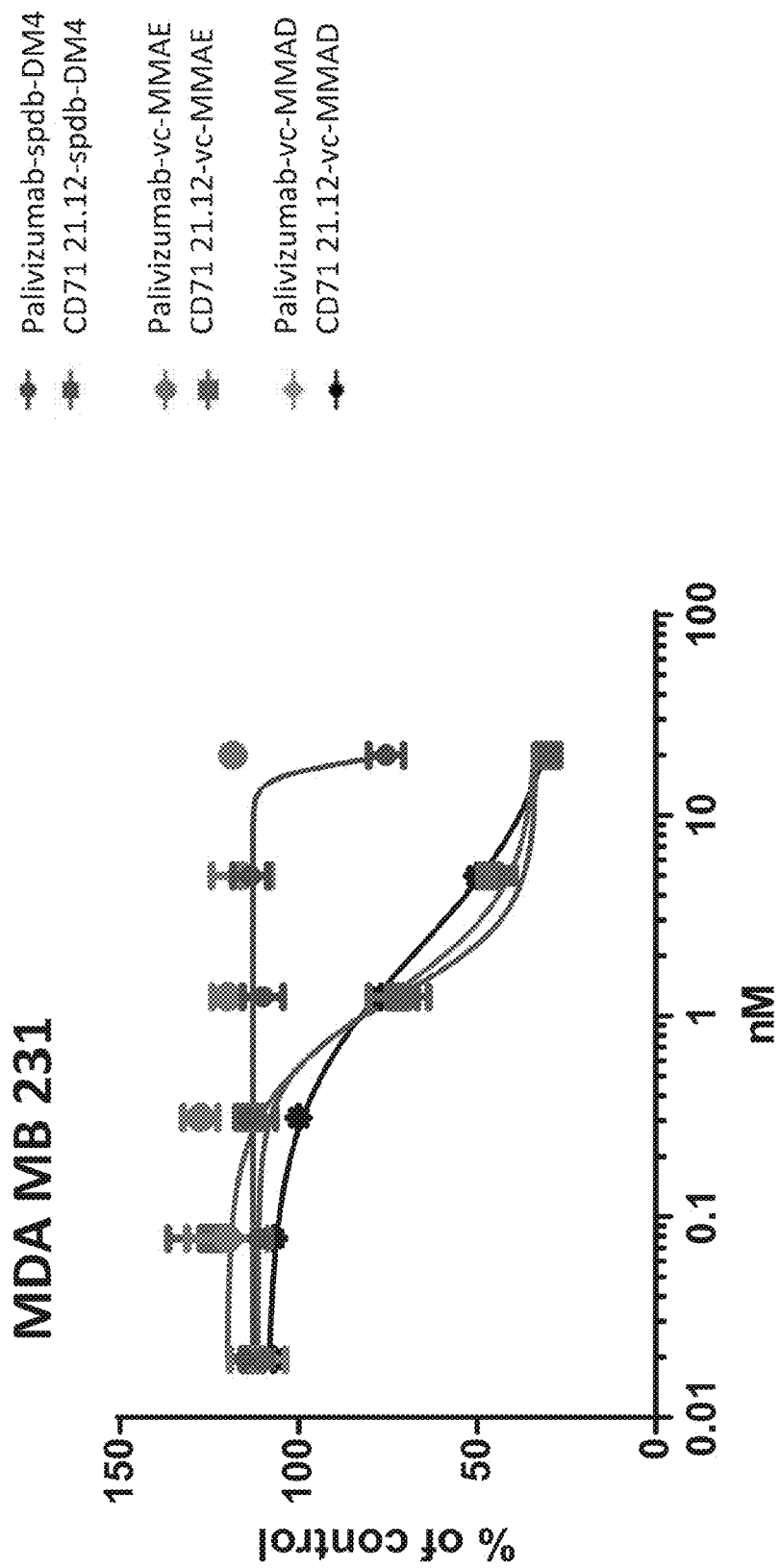

FIGS. 17A to 17D show that anti-human CD71 antibody of the present disclosure conjugated to various toxins demonstrate higher in vitro cytotoxicity against various CD71-expressing cell lines as compared to an isotype control ADC. In this study, anti-human CD71 21.12-ADC of the present disclosure (conjugated to either spdb-DM4, vc-MMAE or vc-MMAD) or an isotype control (palivizumab-ADC, conjugated to either spdb-DM4, vc-MMAE or vc-MMAD) as applied at the indicated concentrations to HT29 (FIG. 17A), BxPc3 (FIG. 17B), FaDu (FIG. 17C), and MDA MB 231 (FIG. 17D). The cytotoxicity was determined as a percentage of a population of untreated cells that were used as a control.

Example 11

Activatable Anti-CD71 Cytotoxicity on NHL Raji Cells

This Example shows that anti-human CD71 antibody drug conjugates (ADCs) of the present disclosure demonstrate a higher cytoxicity against a Raji (non-Hodgkin's lymphoma) cell line as compared to anti-human CD71 activatable antibody drug conjugates (AADCs) of the present disclosure.

Figure 18:
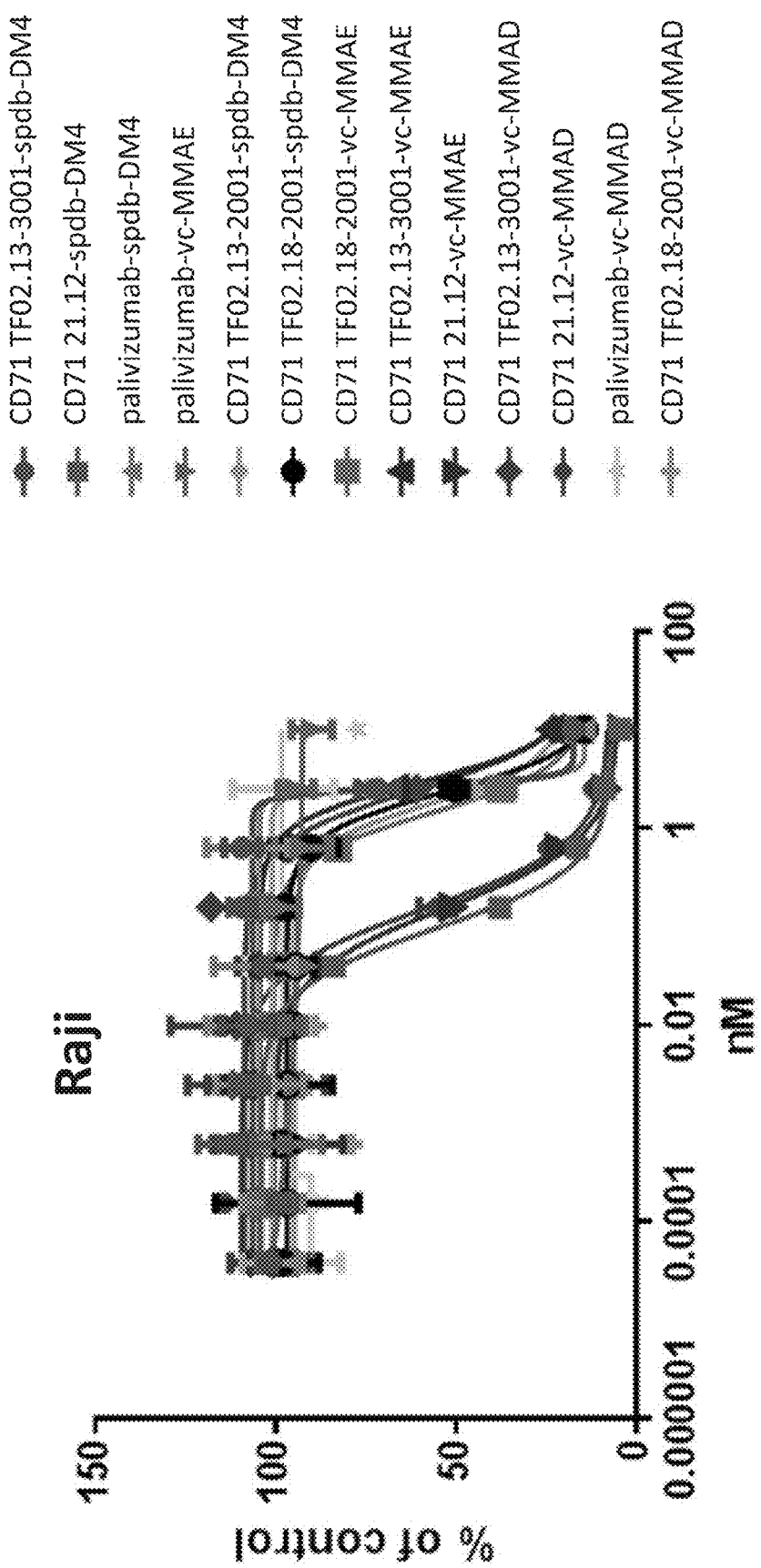
FIG. 18 depicts exemplary studies of the cytotoxicity of various activatable anti-CD71 antibody drug conjugates of the present disclosure on a non-Hodgkin's lymphoma-derived Raji cell line.

FIG. 18 shows that anti-human CD71 21.12-ADC drug conjugates (ADCs) of the present disclosure (conjugated to either spdb-DM4, vc-MMAE or vc-MMAD) showed a higher cytoxicity against Raji non-Hodgkin's lymphoma-derived cells than that of either their corresponding anti-human CD71 TF02.18-2001-AADC activatable antibody drug conjugates (conjugated to either spdb-DM4, vc-MMAE or vc-MMAD) or anti-human CD71 TF02.13-3001-AADC activatable antibody drug conjugates (conjugated to either spdb-DM4, vc-MMAE or vc-MMAD). The anti-human CD71 ADCs demonstrated a similar cytotoxic efficacy to each other (showing an IC50 of ~0.1 nM based on comparison to a control sample) against the Raji cell line. In comparison, the anti-human CD71 activatable antibody drug conjugate (AADC) showed a cytotoxic effect that is similar or comparable to that of the isotype-ADC control. In this study, the various anti-human CD71 antibody drug conjugates and activatable antibody drug conjugates of the present disclosure were applied at the indicated concentrations to Raji cells. The cytotoxicity was determined as a percentage of a population of untreated cells that were used as a control.

Example 12

CD71 Binding Assay

This Example show that anti-human CD71 activatable antibodies of the present disclosure demonstrated a shifted binding affinity to recombinant CD71 protein compared to the parental anti-CD71 antibody of the present disclosure.

Figure 19:
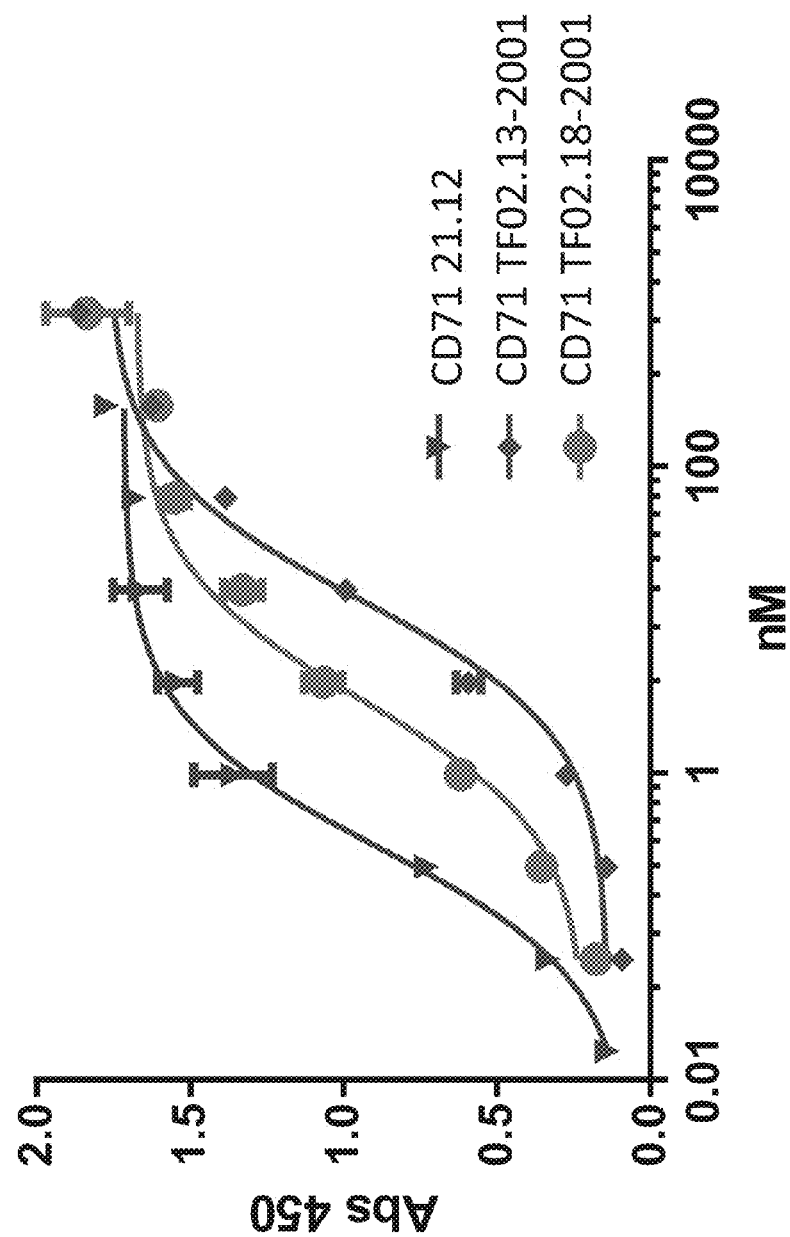
FIG. 19 depicts an exemplary study of the ability of various anti-CD71 activatable antibodies of the disclosure to bind human CD71.

As shown by the examples depicted in FIG. 19, a solid-phase binding assay was used to demonstrate the binding of anti-human CD71 antibodies of the present disclosure. In these examples, recombinant human CD71 protein (R&D Systems) was coated on nickel-plated ELISA plates at a concentration of 1 µg/mL, and then incubated with the indicated concentration of anti-CD71 antibody ("CD71 21.12") or activatable anti-CD71 antibodies ("CD71.TF02.13-2001" or "CD71.TF02.18-2001"), where in the activatable antibodies were assayed in their non-proteolytically-activated form. The amount of bound antibody was detected by incubation and detection by goat anti-human antibody conjugated to horseradish peroxidase and Ultra TMB (Thermo Fisher Scientific) detection.

As depicted in FIG. 19, the exemplary assay demonstrated that the anti-human CD71 21.12 antibody bound with a Kd of ~0.3 nM. The binding constants of anti-human CD71 TF02.18-2001 and human CD71 TF02.13-2001 activatable antibodies are shifted to the right as a result of their respective masking efficiencies (9 and 42 fold respectively).

TABLE 15

Exemplary Observed CD71 Binding Activity of Activatable Anti-CD71 Antibodies

| Antibody | Kd (nM) 1 µg/mL CD71 antigen | ME* |
|---|---|---|
| CD71 21.12 | 0.3 | — |
| CD71 TF02.13-2001 | 13 | 42 |
| CD71 TF02.18-2001 | 3.0 | 9 |

*ME = masking efficiency

Example 13

Activatable Anti-CD71-AADC in vivo Efficacy in a Patient-Derived Xenograft Model of Non-Hodgkin's Lymphoma This Example shows that an anti-human CD71 activatable antibody with conjugated toxins of the present disclosure (AADC) is efficacious in a non-Hodgkin's lymphoma (NHL) patient-derived xenograft model, and that this efficacy is comparable to or better than that observed with a parental anti-human CD71 antibody drug conjugate (ADC).

Figure 20A:
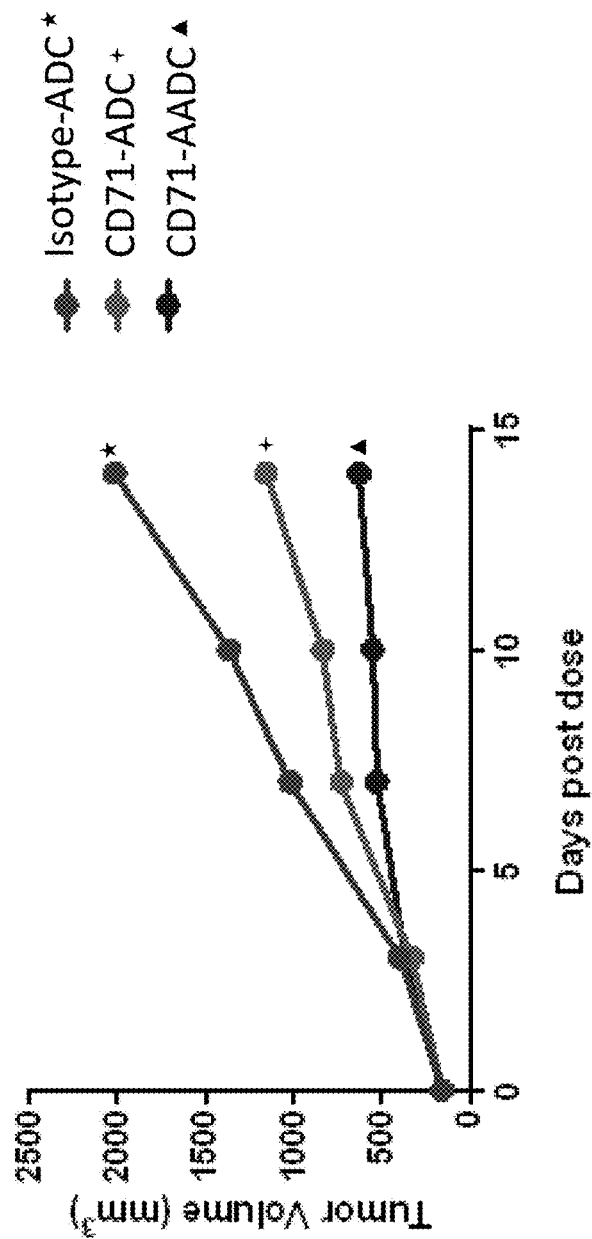
FIGS. 20A and 20B depicts an exemplary study of the efficacy of anti-CD71 antibody drug conjugates (ADC) and anti-CD71 activatable antibody drug conjugates (AADC) of the present disclosure in a patient-derived xenograft tumor model.
Figure 20B:
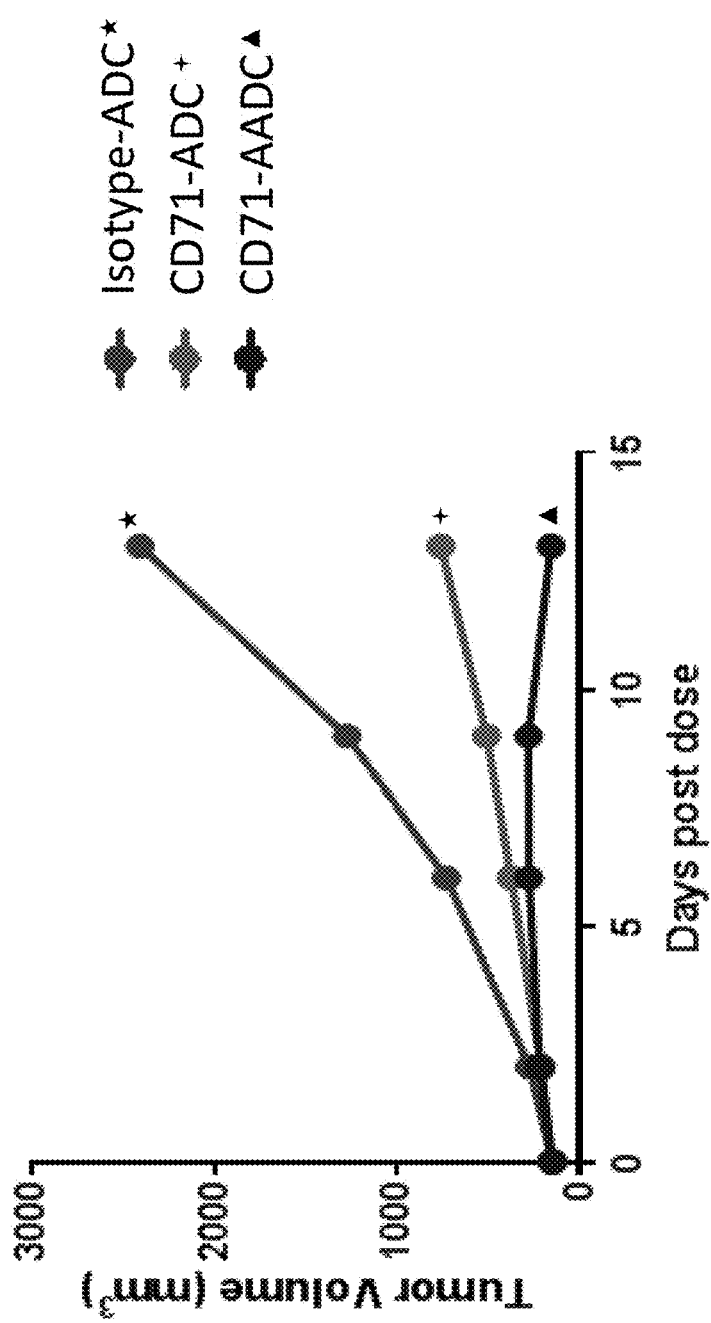
Figure 21A:
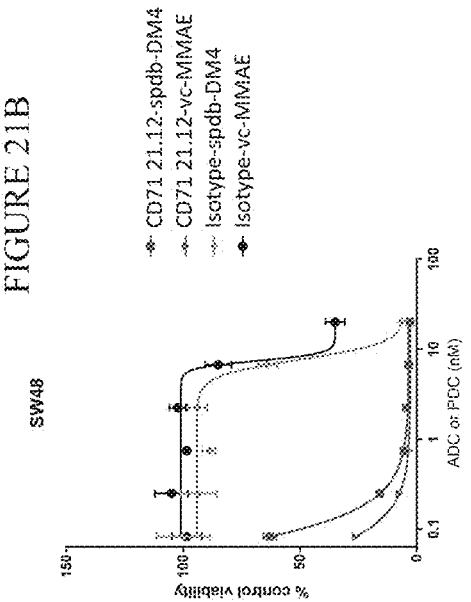
FIGS. 21A-21H depict exemplary studies of the cytotoxicity of various anti-CD71 antibody drug conjugates of the present disclosure on a variety of colorectal cancer-derived cell lines.
Figure 21B:
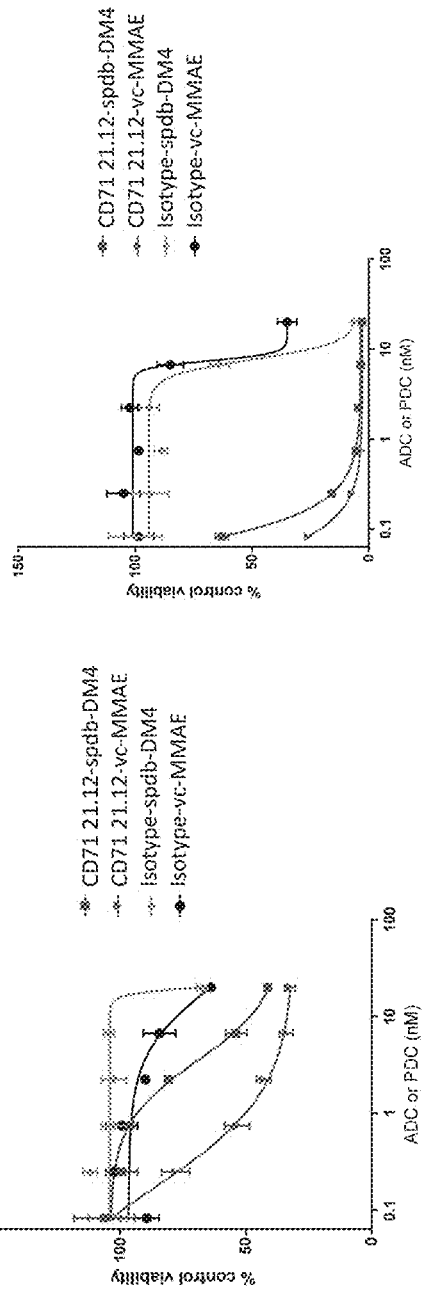
Figure 21C:
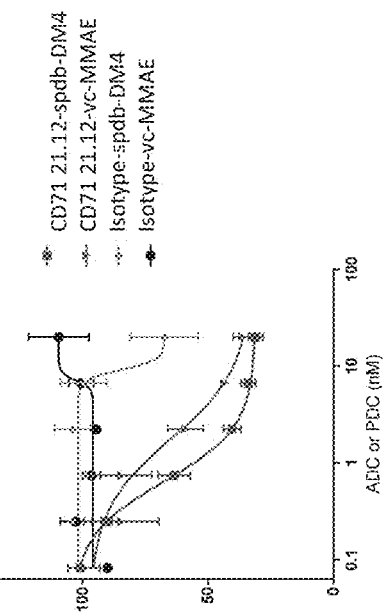
Figure 21D:
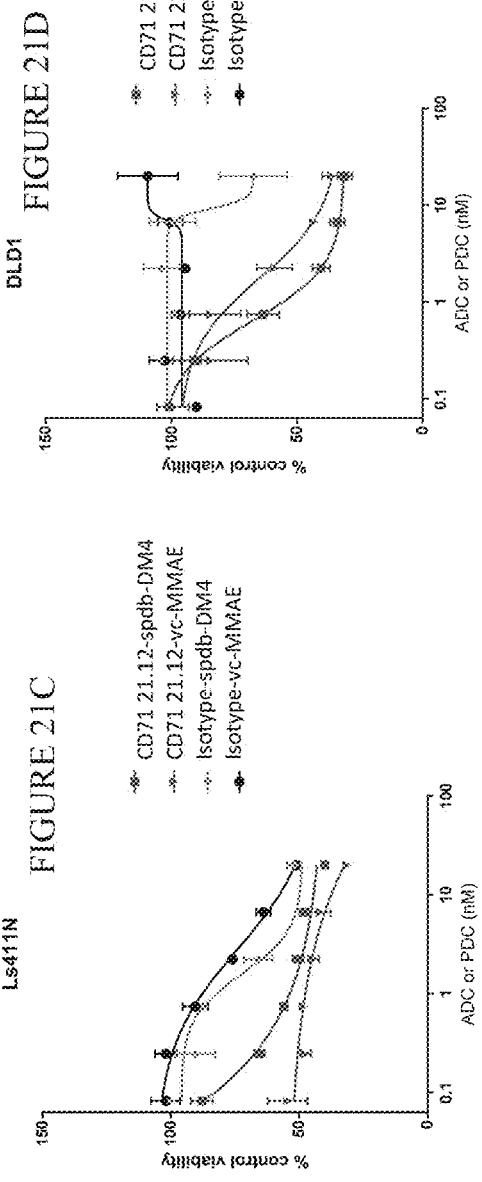
Figure 21E:
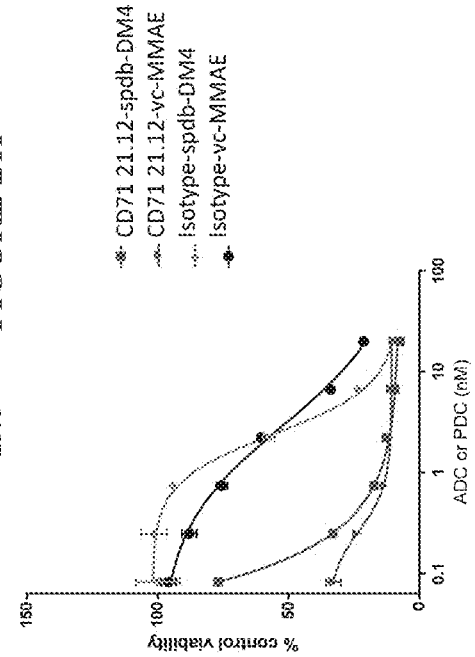
Figure 21F:
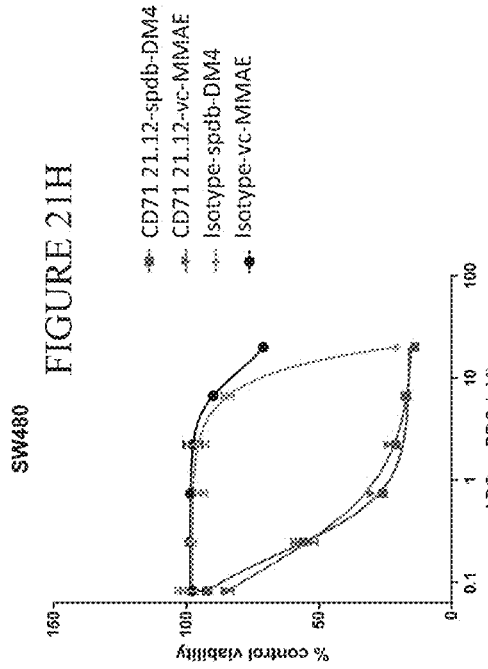
Figure 21G:
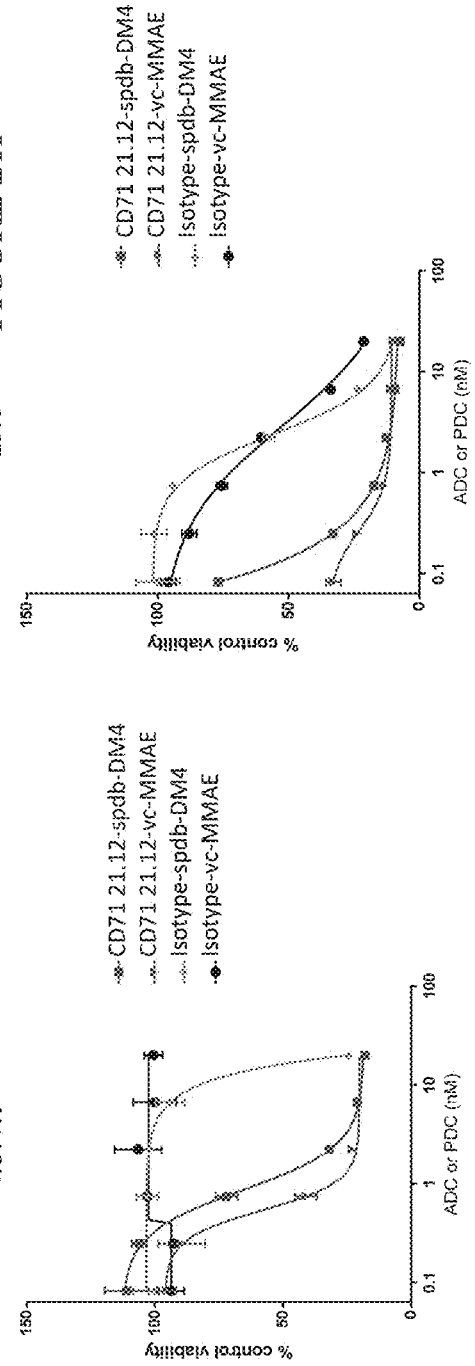
Figure 21H:
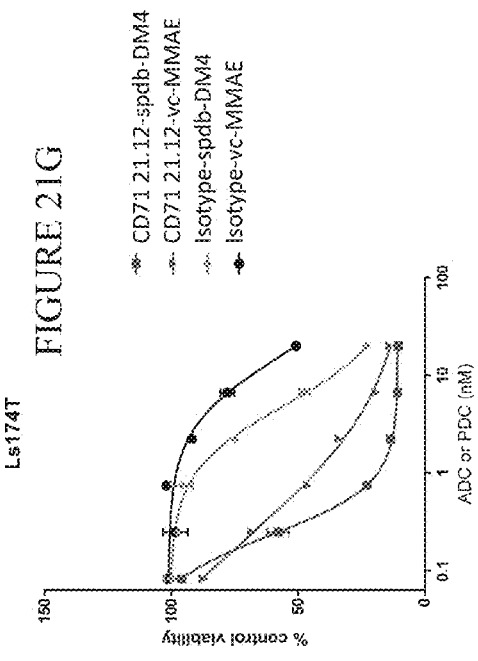

FIGS. 20A and 20B show that using a patient-derived xenograft mouse model of non-Hodgkin's lymphoma (NHL) primary tumor, mice treated with an activatable anti-huCD71-AADC of the present disclosure showed over time efficacies that were similar to or higher than that of their respective anti-huCD71-ADC of the present disclosure. In this study, two patient-derived NHL xenografts (labeled as LY2214 and LY0257, Crown Bioscience) were each treated with an isotype-ADC control (palivizumab conjugated to spdb-DM4, "Isotype-ADC"); activatable anti-huCD71 21.12-ADC of the present disclosure conjugated to spdb-DM4 ("CD71-ADC") of the present disclosure; or activatable anti-huCD71 TF02.13.3001 of the present disclosure conjugated to spdb-DM4 ("CD71-AADC"). In each of the examples, tumor xenografts were grown to an average volume of 150 mm³; then the mice were randomized into groups of 4 and dosed on days 1 and 7 with 5 mg/kg of the indicated test articles. The mean tumor volume±SEM is plotted for each time point.

Example 14

Anti-CD71-ADC Cytotoxicity on Multiple Colorectal Cancer-Derived Cell Lines

This Example shows that anti-human CD71 antibody drug conjugates (ADCs) of the present disclosure demonstrate a higher cytotoxicity against multiple colorectal cancer (CRC)-derived cell lines as compared to isotype-ADC controls.

FIGS. 21A-21H show that anti-human CD71 21.12 antibody drug conjugates (ADCs) of the present disclosure conjugated to either spdb-DM4 or vc-MMAE showed a higher cytotoxicity against a variety of CRC-derived cell lines than that of an isotype antibody (chKTI, a chimeric human IgG1 anti-soybean trypsin inhibitor antibody) conjugated to either spdb-DM4 or vc-MMAE. The CRC-derived cell lines that were treated with the ADCs were SW1417, SW48, Ls411N, Lovo, HCT116, DLD1, Ls174T, and SW480. The anti-human CD71 ADCs demonstrated a similar cytotoxic efficacy to each other against the cell lines. In this study, the various anti-human CD71 antibody drug conjugates of the present disclosure and isotype drug conjugates were applied at the indicated concentrations to the cells. The cytotoxicity was determined as a percentage of a population of untreated cells that were used as a control.

FIGS. 22A and 22B shows that anti-human CD71 21.12-ADC drug conjugates (ADCs) of the present disclosure conjugated to vc-MMAE or vc-MMAD (CD71 21.12-vc-MMAE, CD71 21.12-vc-MMAD) showed a higher cytotoxicity against a HT29 CRC-derived cells than that of either their corresponding anti-human CD71 TF02.18-2001-AADC activatable antibody drug conjugate conjugated to vc-MMAE or vc-MMAD (CD71 TF02.18-2001-vc-MMAE, CD71 TF02.18-2001-vc-MMAD), an anti-human CD71 TF02.13-3001-AADC activatable antibody drug conjugate conjugated to vc-MMAE or vc-MMAD (CD71 TF02.13-3001-vc-MMAE, CD71 TF02.13-3001-vc-MMAD), or an isotype control (palivizumab-ADC) conjugated to vc-MMAE or vc-MMAD (Isotype-vc-MMAE, Isotype-vc-MMAD). In this study, the various anti-human CD71 antibody drug conjugates and activatable antibody drug conjugates of the present disclosure, as well as the isotype-ADC, were applied at the indicated concentrations to HT29 cells. The cytotoxicity was determined as a percentage of a population of untreated cells that were used as a control.

Example 15

Activatable Anti-CD71-AADC In Vivo Efficacy in a Xenograft Model of Non-Hodgkin's Lymphoma This Example shows that anti-human CD71 activatable antibodies with conjugated toxins (AADCs) of the present disclosure are efficacious in a non-Hodgkin's lymphoma (NHL) mouse xenograft model. These efficacies are specific to anti-human CD71 antibodies and are comparable or equivalent to the efficacy demonstrated by a parental anti-human CD71 drug conjugates.

Figure 23A:
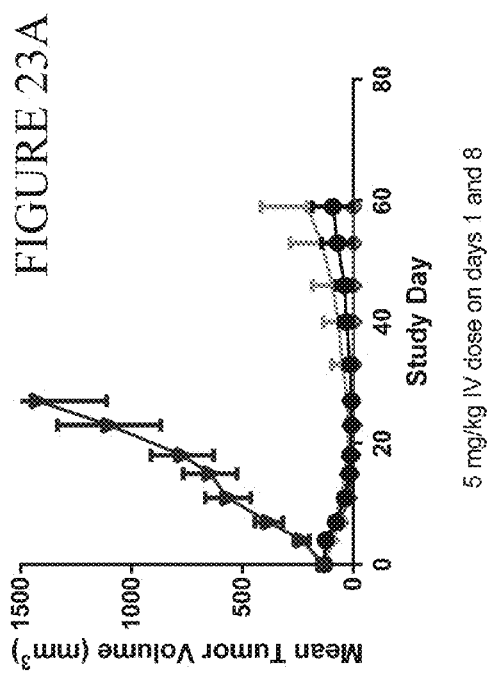
FIGS. 23A and 23B depict exemplary efficacy studies of activatable anti-CD71 conjugated antibodies (AADCs) of the present disclosure using non-Hodgkin's lymphoma tumor xenografts in mice.

FIG. 23A shows the efficacy of various anti-CD71 activatable antibody drug conjugates in a mouse NHL (Raji) xenograft model, where the activatable antibody drug conjugates of the present disclosure (CD71 TF02.18-2001-spdb-DM4, CD71 TF02.13-2001-spdb-DM4, and CD71 TF02.13.3001-spdb-DM4) showed significantly higher efficacy than an isotype control (palivizumab-spdb-DM4). The figure also shows that the activatable antibody drug conjugates of the present disclosure demonstrated an efficacy comparable to an unmasked anti-CD71 antibody drug conjugate (CD71 21.12-spdb-DM4). In this study, non-Hodgkin's lymphoma (NHL) Raji xenograft tumors in mice were grown to an average volume of 150 mm$^3$. The mice were then randomized into groups of eight and dosed on days 1 and 8 with 5 mg/kg of each indicated test article. The mean tumor volume±SEM was plotted for each time point.

Figure 23B:
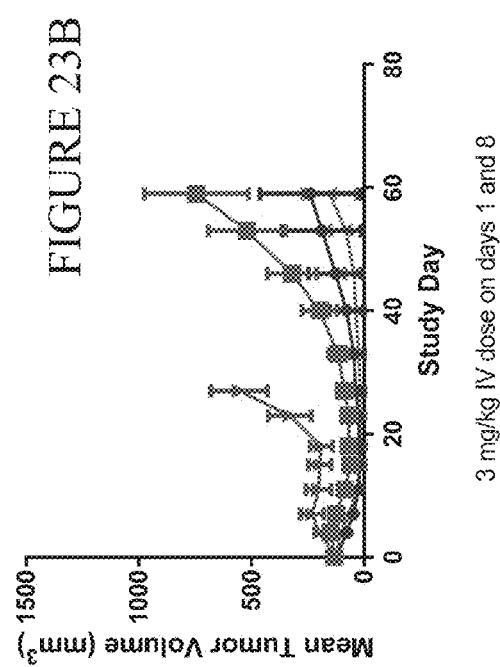

FIG. 23B shows the efficacy of various anti-CD71 activatable antibody drug conjugates in a mouse NHL (Raji) xenograft model, where the activatable antibody drug conjugates of the present disclosure (CD71 TF02.18-2001-vc-MMAE and CD71 TF02.13-3001-vc-MMAE) showed significantly higher efficacy than an isotype control (palivizumab-vc-MMAE). The figure also shows that the activatable antibody drug conjugates of the present disclosure demonstrated an efficacy comparable to an unmasked anti-CD71 antibody drug conjugate (CD71 21.12-vc-MMAE). In this study, non-Hodgkin's lymphoma (NHL) Raji xenograft tumors in mice were grown to an average volume of 150 mm$^3$. The mice were then randomized into groups of eight and dosed on days 1 and 8 with 3 mg/kg of each indicated test article. The mean tumor volume±SEM was plotted for each time point.

Example 16

Activatable Anti-CD71-AADC in vivo Efficacy in a Xenograft Model of Non-Small Cell Lung Carcinoma This Example shows that anti-human CD71 activatable antibodies with conjugated toxins (AADCs) of the present disclosure are efficacious in a non-small cell lung carcinoma (NSCLC) mouse xenograft model over a range of dosages. These efficacies are specific to anti-human CD71 antibodies and are comparable or equivalent to the efficacy demonstrated by a parental anti-human CD71 drug conjugate.

FIGS. 24A and 24B show the efficacy of anti-CD71 activatable antibody drug conjugates in a mouse NSCLC xenograft model, where the activatable antibody drug conjugates of the present disclosure (CD71 TF02.13-3001-spdb-DM4, CD71 TF02.13-2001-spdb-DM4, CD71 TF01-2001-PEG2-vc-MMAD) at the indicated dosages (5 mg/kg, 3 mg/kg, and 1 mg/kg) showed significantly higher efficacy than an isotype control (palivizumab-spdb-DM4 or palivizumab-PEG2-vc-MMAD) administered at a 5 mg/kg dosage. The figure also shows that the activatable antibody drug conjugates of the present disclosure demonstrated an efficacy comparable to an unmasked anti-CD71 antibody drug conjugate (CD71 21.12-spdb-DM4 or CD71 21.12-PEG2-vc-MMAD) at 5 mg/kg dosage. In this study, NSCLC H292 xenograft tumors in mice were grown to an average volume of 150 mm$^3$. The mice were then randomized into groups of eight and dosed on days 1 and 8 with the indicated amount of each indicated test article. The mean tumor volume±SEM was plotted for each time point.

Example 17

Activatable Anti-CD71-AADC in vivo Efficacy in a Xenograft Model of Pancreatic Adenocarcinoma This Example shows that anti-human CD71 activatable antibodies with conjugated toxins (AADCs) of the present disclosure are efficacious in a BxPC3 pancreatic adenocarcinoma mouse xenograft model over a range of dosages. These efficacies are specific to anti-human CD71 antibodies and are comparable or equivalent to the efficacy demonstrated by a parental anti-human CD71 drug conjugate, and/or higher than the efficacy of an isotype control ADC.

Figure 25:
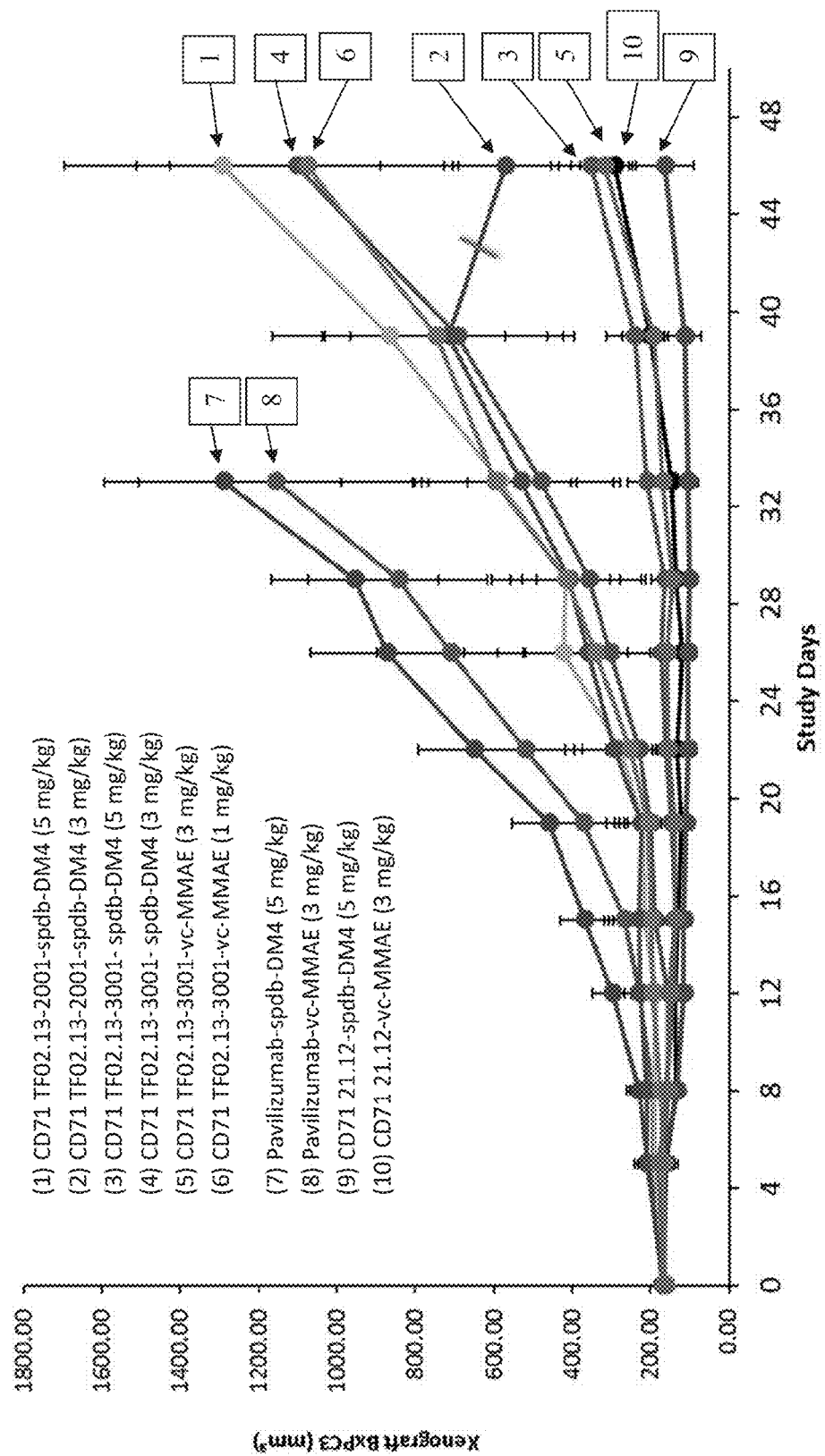
FIG. 25 depicts exemplary efficacy studies of activatable anti-CD71 conjugated antibodies (AADCs) of the present disclosure using pancreatic cancer (BxPC3) tumor xenografts in mice.

FIG. 25 shows the efficacy of various anti-CD71 activatable antibody drug conjugates in a BxPC3 mouse xenograft model, where the activatable antibody drug conjugates of the present disclosure (CD71 TF02.13-2001-spdb-DM4, CD71 TF02.13-3001-spdb-DM4, and CD71 TF02.13-3001-vc-MMAE) each at the indicated dosages showed significantly higher efficacy than an isotype control (palivizumab-spdb-DM4 at 5 mg/kg and palivizumab-vc-MMAE at 3 mg/kg). The figure also shows that the activatable antibody drug conjugates of the present disclosure demonstrated an efficacy comparable to an unmasked anti-CD71 antibody drug conjugate (CD71 21.12-spdb-DM4 at 5 mg/kg and CD71 21.12-vc-MMAE at 3 mg/kg). In this study, BxPC3 xenograft tumors in mice were grown to an average volume of 150 mm$^3$. The mice were then randomized into groups of eight and dosed on day 1 with the indicated amount of each indicated test article. The mean tumor volume±SEM was plotted for each time point.

Example 18

Activatable Anti-CD71-AADC in vivo Efficacy in a Patient-Derived Xenograft Model of Non-Hodgkin's Lymphoma This Example shows that an anti-human CD71 activatable antibody with conjugated toxins of the present disclosure (AADC) is efficacious in a non-Hodgkin's lymphoma (NHL) patient-derived xenograft model, and that this efficacy is comparable to or better than that observed with a parental anti-human CD71 antibody drug conjugate (ADC).

FIGS. 26A and 26B show that using a patient-derived xenograft mouse model of non-Hodgkin's lymphoma (NHL) primary tumor, mice treated with an activatable anti-hu CD71-AADC (CD71 TF02.13-3001-spdb-DM4 and CD71 TF02.13-3001-vc-MMAD) of the present disclosure showed over time efficacies that were similar to or higher than that of their respective anti-huCD71-ADC of the present disclosure. In this study, two patient-derived NHL xenografts (labeled as LY2214 and LY0257, Crown Bioscience) were each treated with a palivizumab isotype-ADC control conjugated to spdb-DM4 ("Isotype-spdb-DM4") or vc-MMAD ("Isotype-vc-MMAD"); antibody drug conjugates of the present disclosure anti-huCD71 21.12-spdb-DM4 or anti-huCD71 21.12-vc-MMAD; or activatable antibodies of the present disclosure anti-hu CD71 TF02.13-3001-spdb-DM4 and anti-huCD71 TF02.13-3001-vc-MMAD. In each of the examples, tumor xenografts were grown to an average volume of 150 mm$^3$; then the mice were randomized into groups of 4 and dosed on days 1 and 7 of the indicated test articles at the indicated dosages. The mean tumor volume±SEM is plotted for each time point.

Example 19

Activatable Anti-CD71-AADC in vivo Efficacy in a Patient-Derived Xenograft Models This Example shows that an anti-human CD71 activatable antibody with conjugated toxins of the present disclosure (AADC) is efficacious in various patient-derived xenograft models, and that this efficacy is higher than that of an isotype control ADC.

FIG. 27A shows that using a patient-derived xenograft mouse model of a lung tumor (CTG-0166), mice treated with an activatable anti-hu CD71-AADC (CD71 TF02.13-3001-spdb-DM4) of the present disclosure showed over time efficacies that were higher than that of their respective isotype-ADC control (chKTI, a chimeric human IgG1 anti-soybean trypsin inhibitor antibody, conjugated to spdb-DM4, "Isotype-spdb-DM4"). FIG. 27B shows that using a patient-derived xenograft mouse model of a endometrial tumor (CTG-0774), mice treated with an activatable anti-hu CD71-AADC (CD71 TF02.13-3001-spdb-DM4) of the present disclosure showed over time efficacies that were higher than that of their respective isotype-ADC control (chKTI conjugated to spdb-DM4, "Isotype-spdb-DM4"). In another study using a patient-derived xenograft mouse model of a cholangiocarcinoma tumor (bile duct cancer) (CTG-1941), mice treated with an activatable anti-hu CD71-AADC (CD71 TF02.13-3001-vc-MMAE) of the present disclosure showed over time efficacies that were higher than that of an isotype-ADC control (chKTI, a chimeric human IgG1 anti-soybean trypsin inhibitor antibody, conjugated to spdb-DM4). In each of the examples, tumor xenografts were grown to an average volume of 150 mm$^3$; then the mice were randomized into groups of 4 and dosed on day 1 with the indicated amount for each of the indicated test articles. The mean tumor volume±SEM is plotted for each time point.

Example 20

CD71 Binding Assay

This Example show that anti-human CD71 activatable antibodies of the present disclosure demonstrated a shifted binding affinity to recombinant CD71 protein compared to the parental anti-CD71 antibody of the present disclosure.

Figure 28:
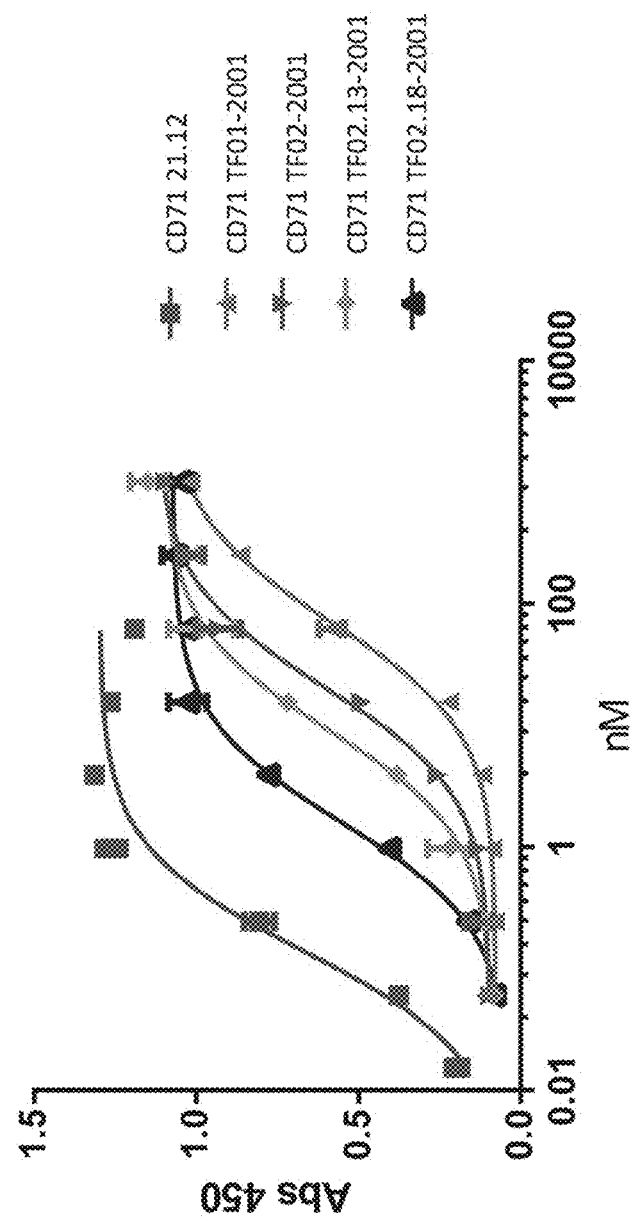
FIG. 28 depicts an exemplary study of the ability of various anti-CD71 antibodies and activatable antibodies of the disclosure to bind human CD71.

As shown by the examples depicted in FIG. 28, a solid-phase binding assay was used to demonstrate the binding of anti-human CD71 antibodies of the present disclosure. In these examples, recombinant human CD71 protein (R&D Systems) was coated on copper or nickel-plated ELISA plates at a concentration of 1 µg/mL, and then incubated with the indicated concentration of anti-CD71 antibody ("CD71 21.12") or activatable anti-CD71 antibodies ("CD71.TF01-2001", "CD71.TF02-2001", "CD71.TF02.13-2001" or "CD71.TF02.18-2001"), where in the activatable antibodies were assayed in their uncleaved form. The amount of bound antibody was detected by incubation and detection by goat anti-human antibody conjugated to horseradish peroxidase and Ultra TMB (Thermo Fisher Scientific) detection.

As depicted in FIG. 28, the exemplary assay demonstrated that the anti-human CD71 21.12 antibody bound with a Kd of ~0.14 nM. The binding constants of activatable anti-CD71 antibodies are shifted to the right as a result of their respective masking efficiencies.

TABLE 16

Exemplary Observed CD71 Binding Activity of Activatable Anti-CD71 Antibodies

| Antibody | Kd (nM) 1 µg/mL CD71 antigen | ME* |
|---|---|---|
| CD71 21.12 | 0.14 | — |
| CD71 TF01-2001 | 69.99 | 500 |
| CD71 TF02-2001 | 21.45 | 153 |
| CD71 TF02.13-2001 | 9.14 | 65 |
| CD71 TF02.18-2001 | 1.59 | 11 |

*ME = masking efficiency

Example 21

CD71 Expression in Normal Human and Cynomolgus Tissues

This Example shows that CD71 is expressed in a large variety of normal human and cynomolgus tissues by immunohistochemical (IHC) staining using an anti-CD71 antibody.

Table 17 shows that CD71 is expressed in certain normal human and cynomolgus tissue samples, using IHC staining with a commercially-purchased anti-CD71 antibody (rabbit anti-CD71 mAb IgG; D7G9X, Cell Signaling Tech.). Table 17 shows a summary of the relative level of IHC staining of CD71 of a variety of formalin-fixed paraffin-embedded normal human and cynomolgus tissues, where each plus sign ("+") corresponds to a higher level of staining, and each minus sign ("−").

TABLE 17

IHC Assay of CD71 Expression in FFPE Normal Tissues

| Tissue Type | Cynomolgus | Human |
|---|---|---|
| Bone | + | ++ |
| Breast | − | − |
| Brain | + | + |
| Colon | − | − |
| Esophagus | − | − |
| Heart | − | − |
| Kidney | + | −/+ |
| Liver | − | − |
| Lung | − | ++ (in a few cells) |
| Nerve | +++ | ++ |
| Ovary | + | + |
| Pancreas | − | − |
| Prostate | − | − |
| Skin | N/A | −/+ |
| Small Intestine | + | − |
| Spleen | − | − |
| Stomach | −/+ | + |
| Striated/Skeletal Muscle | − | − |
| Testis | − | + |
| Uterus | − | −/+ |

Example 22

CD71 Expression in Multiple Primary and Metastatic Tumors

This Example shows that CD71 is expressed in a large number and variety of patient-derived tumors by immunohistochemical (IHC) staining using an anti-CD71 antibody.

Table 18 shows that CD71 is moderately or highly expressed in a large number and variety of patient-derived tumor samples, using IHC staining with a commercially-purchased anti-CD71 antibody on multiple patient-derived tumor tissue microarrays (TMA). Table 18 shows a summary of the level of IHC staining of CD71 of the TMAs shows that a large number of cores derived from multiple patient-derived samples showed a strong CD71 signal. The number in parentheses following each type of cancer indicate the number of individual patient-derived samples.

TABLE 18

IHC Assay of CD71 Expression In Patient-Derived Cancers

| Cancer Type (Total No. of Samples) | Samples with IHC Score (%) | | |
|---|---|---|---|
| | 0 | 1 | 2/3 |
| Colorectal Cancer (228) | 1 (0.4) | 20 (8.8) | 207 (90.8) |
| Pancreatic Cancer (1060 | 0 (0) | 26 (24.5) | 90 (75.5) |
| Small Cell Lung Cancer (8) | 2 (25) | 4 (50) | 2 (25) |
| Non-Small Cell Lung Cancer (42) | 2 (3.2) | 26 (41.9) | 34 (54.8) |
| Ovarian Cancer (53) | 3 (7.1) | 19 (45.2) | 20 (47.6) |
| Head and Neck Squamous Cell Carcinoma (53) | 3 (5.7) | 20 (38) | 30 (57) |
| Breast Cancer (41) | 1 (2.4) | 15 (36.6) | 57 (61.0) |
| Gastric Cancer (17) | 0 (0) | 6 (35.3) | 11 (64.7) |
| Esophaegeal Cancer (14) | 0 (0) | 7 (50) | 7 (50) |

Example 23

CD71 Fab Binding Assay

This Example shows that an anti-human CD71 antigen-binding fragment (Fab) of the present disclosure, which is derived from anti-human CD71 antibody of the present disclosure, demonstrated a binding affinity to recombinant human and cynomolgus CD71 protein.

A Fab antigen-binding fragment was generated by digestion of anti-CD71 21.12 antibody of the present disclosure with the papain enzyme in accordance with known protocols to generate an anti-CD71 Fab fragment. The anti-CD71 Fab fragment of the present disclosure was assayed for binding to recombinant human or cynomolgus CD71 protein by measurement of the kinetic on- and off-rates of a 1:3 dilution series of the Fab fragment to a substrate-immobilized recombinant CD71 protein (Octet system, ForteBio). The recombinant CD71 proteins included a hexa-histidine ($His_6$) peptide tag, by which the protein was immobilized to a Ni-NTA (nitrilotriacetic acid)-containing substrate. The results are shown in Table 19.

TABLE 19

Binding Kinetics of Anti-CD71 Fab to Human and Cynomolgus CD71

| Target | $k_{on}$ (1/Msec) | $k_{dis}$ (sec$^{-1}$) | $K_d$ (nM) |
|---|---|---|---|
| Human CD71-$His_6$ | $6.64 \times 10^5$ | $3.98 \times 10^{-3}$ | 14 |
| Cyno CD71-$His_6$ | $3.90 \times 10^5$ | $5.59 \times 10^{-3}$ | 6 |

Example 24

Histopathology of Cynomolgus Monkeys after ADC Treatment

This Example describes a study in which a cynomolgus monkey treated with an anti-human CD71 antibody drug conjugate (ADC) of the present disclosure demonstrated histopathological abnormalities as a result of the toxicity of the ADC.

Two male cynomolgus monkeys were each given a single intravenous dose of an ADC of the present disclosure (CD71 21.12-spdb-DM4) at either 5 mg/kg or 7.5 mg/kg dosage. The specimen given the 7.5 mg/kg dose was subsequently euthanized on day 11 of the study due to moribundity, and its tissues were examined. Light microscopic examination of a limited selection of tissues revealed prominent, interrelated intestinal lesions (e.g., ulceration, inflammation, hemorrhage, bacterial overgrowth, and/or fibrino-necrotic exudate in the colon, duodenum, and jejunum). The specimen also exhibited lung hemorrhage, necrosis, inflammation, and bacteria, suggestive of secondary bacteremia. Ulceration and bacteria in the tongue were also observed. Marked splenic lymphoid hyperplasia was also noted.

The moribundity of the specimen may be attributable to, for example, the fulminant and extensive intestinal lesions, as well as the secondary systemic lesions (e.g., in the lung). The development of the intestinal and systemic lesions may be attributable to, for example, observed marked femoral bone marrow myeloid depletion and/or clinically observed neutropenia.

Example 25

CD71 Expression on H292, HCC1806, and MDA MB 231 Cell Lines

This Example shows that anti-human CD71 activatable antibodies of the present disclosure and anti-human CD71 activatable antibody drug conjugates of the present disclosure bind CD71 on multiple cell lines with a higher dissociation constant than that of the unmasked anti-human CD7 antibody of the present disclosure, thus showing the effect of the mask in reducing binding prior to activation.

Figure 29A:
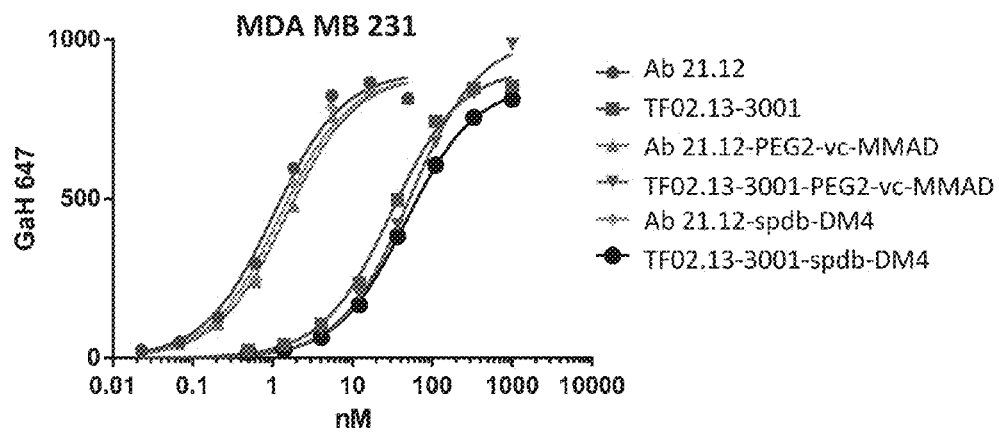
FIGS. 29A to 29C depict exemplary studies of the ability of various anti-CD71 activatable antibodies and activatable antibody drug conjugates of the present disclosure to bind human CD71 on various human-derived cell lines.
Figure 29B:
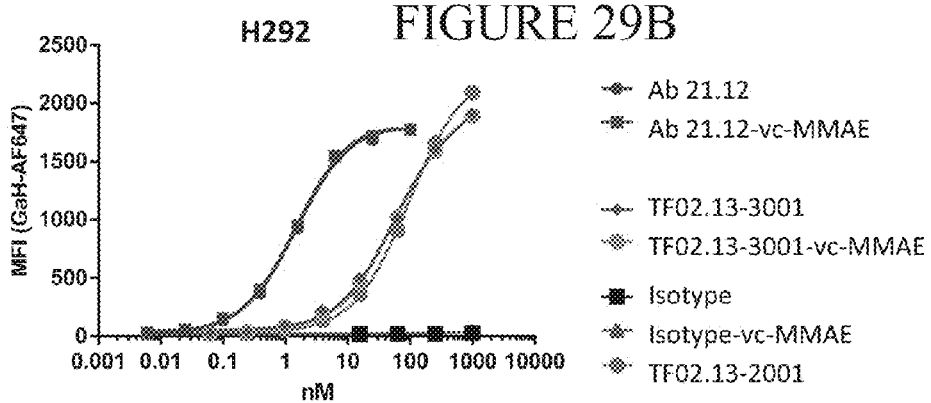
Figure 29C:
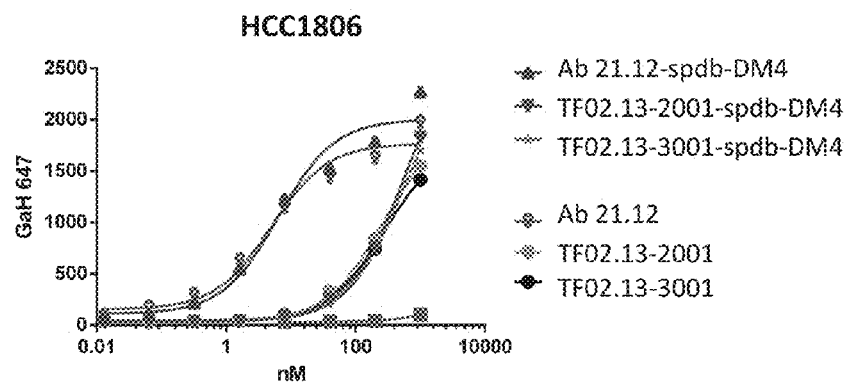

FIGS. 29A, 29B, and 29C shows the amount of binding of anti-CD71 activatable antibodies, activatable antibody drug conjugates, and parental antibodies of the present disclosure to the cell lines MDA MB 231 (FIG. 29A), H292 (FIG. 29B), and HCC1806 (FIG. 29C). In this study, the binding of the antibodies of the present disclosure to the indicated cell lines were performed using a standard FACS labelling method. Briefly, cells were labeled with the indicated antibodies or activatable antibodies of the present disclosure: an isotype control (palivizumab), human CD71 antibody (anti-human CD71 Ab 21.12 antibody), an anti-human CD71 activatable antibodies (anti-human CD71 TF02.13-2001 or anti-human CD71 TF02.13-3001). In addition, cell were also labeled with an isotype ADC control (palivizumab-vc-MMAE), an anti-human CD71 antibody drug conjugate (ADC) of the present disclosure (CD71 Ab21.12-PEG2-vc-MMAD, CD71 Ab 21.12-vc-MMAE, or CD71 Ab 21.12-spdb-DM4), or an activatable antibody drug conjugate (AADC) of the present disclosure: CD71 TF02.13-3001-PEG2-vc-MMAD, CD71 TF02.13-3001-vc-MMAE, CD71 TF02.13-2001-spdb-DM4 or CD71 TF02.13-3001-spdb-DM4) at the indicated concentrations and subsequently detected with an Alexa Fluor 647 labeled goat anti-human IgG secondary antibody.

Table 20 below shows the equilibrium dissociation constants and Bmax values based on the binding curves depicted in FIGS. 29A to 29C. These results show that anti-human CD71 Ab 21.12 antibody bound all cell lines with similar Kd, while the binding of anti-human CD71 activatable antibodies and activatable antibody drug conjugates of the present disclosure to the cell lines demonstrated a significantly higher Kd, which is indicative of the masking efficiency of the masking moiety in the activatable antibodies of the present disclosure.

TABLE 20

Exemplary Observed CD71 Binding Activity of Anti-CD71 Binders

| Article | MDA MB231 Kd (nM) | H292 Kd (nM) | H292 Bmax (MFI) | HCC1806 Kd (nM) |
|---|---|---|---|---|
| Ab 21.12 | 1.032 | 1.533 | 1824 | 5.0 |
| Ab 21.12-PEG2-vc-MMAD | 1.471 | — | — | — |
| Ab 21.12-vc-MMAE | — | 1.328 | 1597 | 6.4 |
| Ab 21.12-spdb-DM4 | 1.238 | — | — | — |
| TF02.13-2001 | — | 92.32 | 2208 | ~200 |
| TF02.13-2001-PEG2-vc-MMAD | — | — | — | — |
| TF02.13-2001-vc-MMAE | — | — | — | — |
| TF02.13-2001-spdb-DM4 | — | — | — | ~200 |
| TF02.13-3001 | 30.60 | 52.12 | 1821 | ~200 |
| TF02.13-3001-PEG2-vc-MMAD | 52.58 | — | — | — |
| TF02.13-3001-vc-MMAE | — | 53.78 | 1848 | — |
| TF02.13-3001-spdb-DM4 | 46.92 | — | — | ~200 |
| Isotype | — | — | — | — |
| Isotype-vc-MMAE | — | 57.05 | 10.64 | — |

Example 26

Binding of Anti-CD71 Activatable Antibodies with Modified Substrates

This Example shows that anti-human CD71 activatable antibodies of the present disclosure bind CD71 on a cell line and in vitro with a higher dissociation constant than that of the unmasked anti-human CD71 antibody of the present disclosure, thus showing the effect of the mask in reducing binding prior to activation.

Figure 30A:
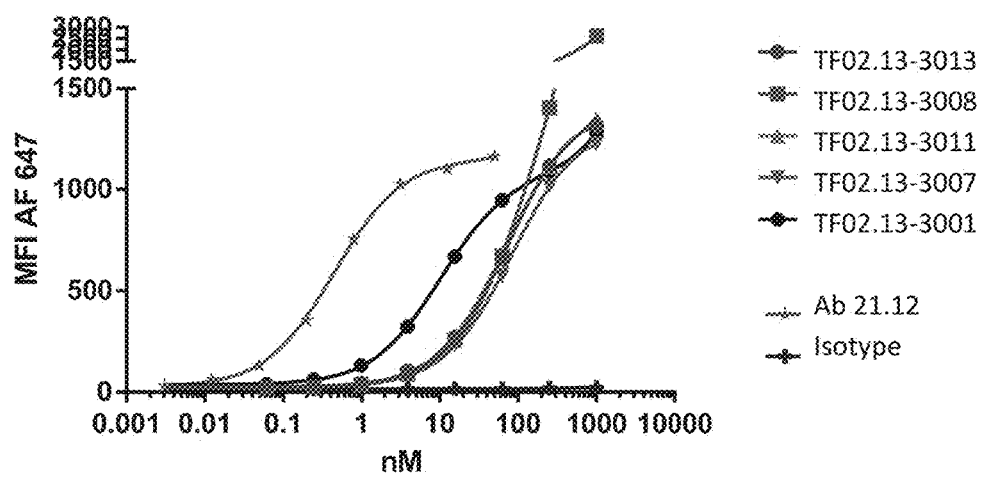
FIGS. 30A to 30D depict exemplary studies of the ability of various anti-CD71 activatable antibodies of the present disclosure to bind human CD71 in vitro and on various human-derived cell lines.
Figure 30B:
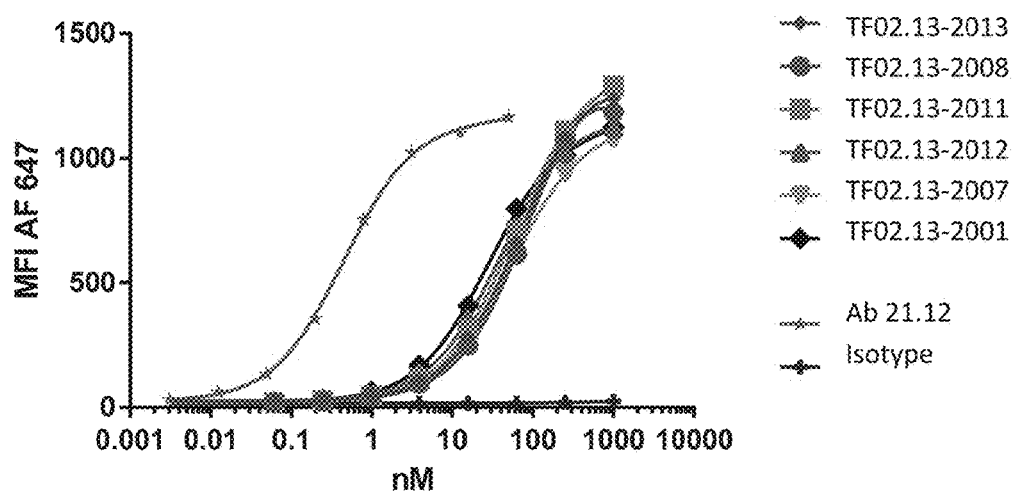

FIGS. 30A and 30B shows the amount of binding of anti-CD71 activatable antibodies and parental antibodies of the present disclosure to the H292 cell line. In this study, the binding of the antibodies of the present disclosure to the indicated cell lines were performed using a standard FACS labelling method. Briefly, cells were labeled with the indicated antibodies or activatable antibodies of the present disclosure: an isotype control (palivizumab), human CD71 antibody (anti-human CD71 Ab 21.12), an anti-human CD71 activatable antibodies (anti-human CD71 TF02.13-3001, TF02.13-3007, TF02.13-3008, TF02.13-3011, TF02.13-3012, TF02.13-3013, TF02.13-2001, TF02.13-2007, TF02.13-2008, TF02.13-2011, TF02.13-2012, TF02.13-2013), where in the activatable antibodies were assayed in their uncleaved form. These activatable antibodies include the light chain of the correspondingly named sequence listed above in Table C. The cells were labeled with the indicated test article at the indicated concentrations and subsequently detected with an Alexa Fluor 647 labeled goat anti-human IgG secondary antibody.

Figure 30C:
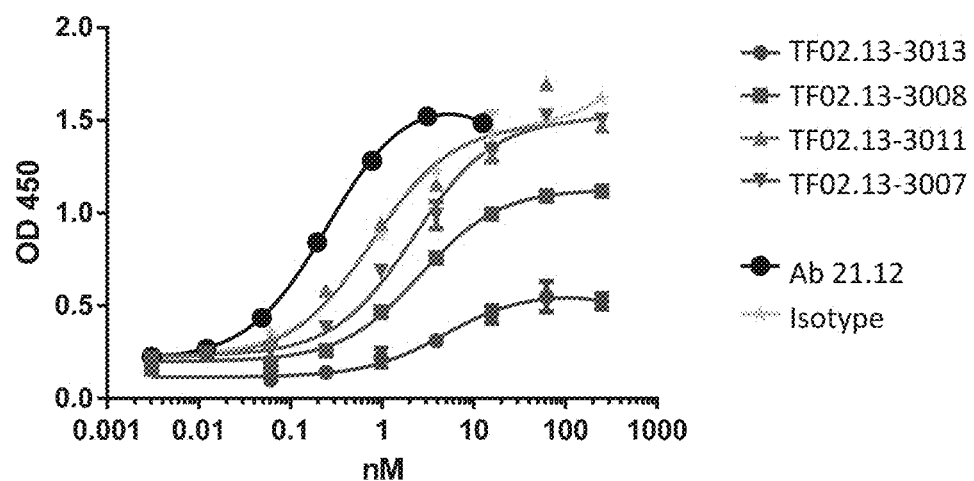
Figure 30D:
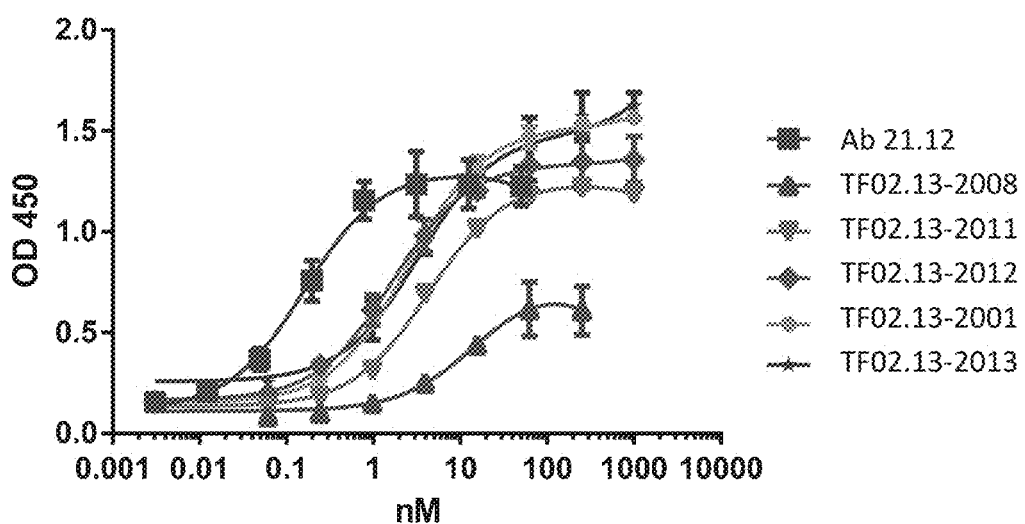
Figure 31A:
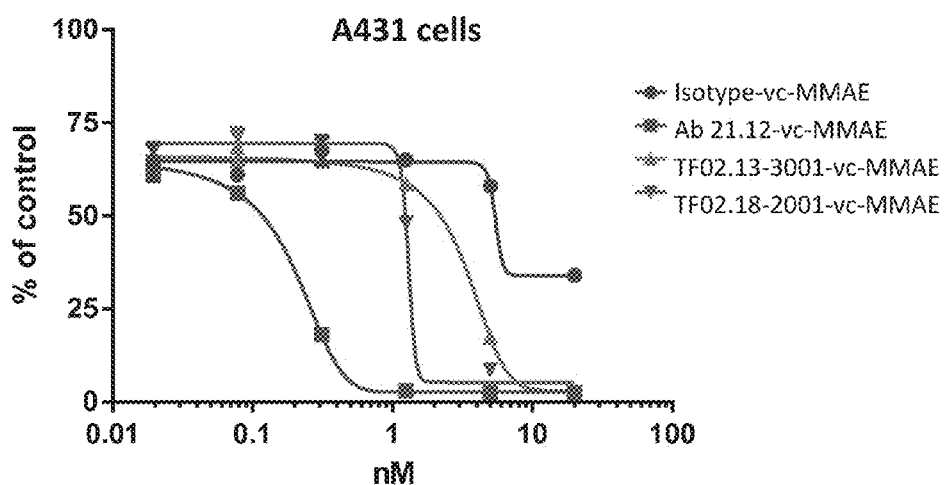
FIGS. 31A to 31J depicts exemplary studies of the cytotoxicity of various anti-CD71 activatable drug conjugates of the present disclosure on various cancer-derived cell lines.
Figure 31B:
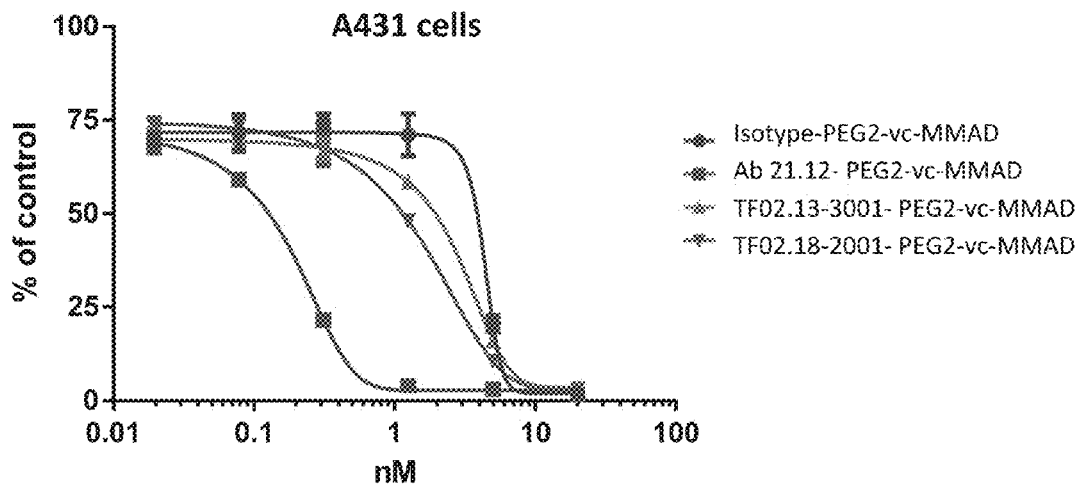
Figure 31C:
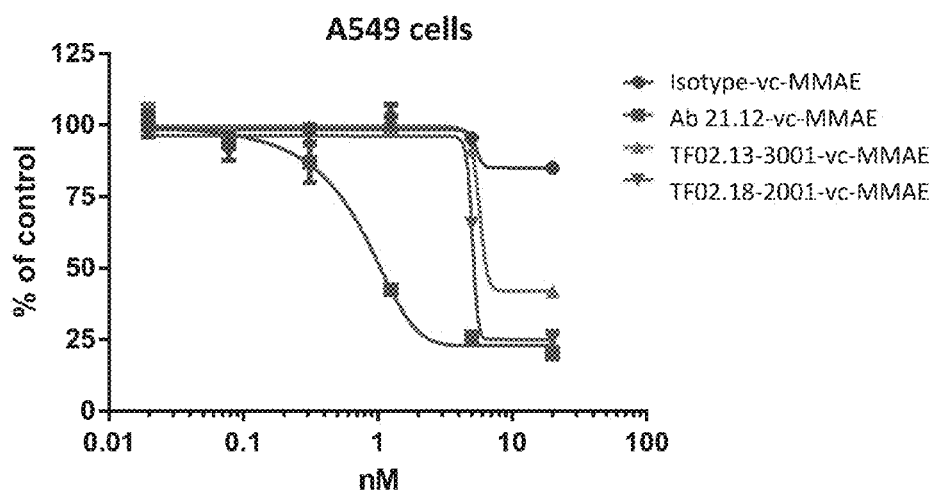
Figure 31D:
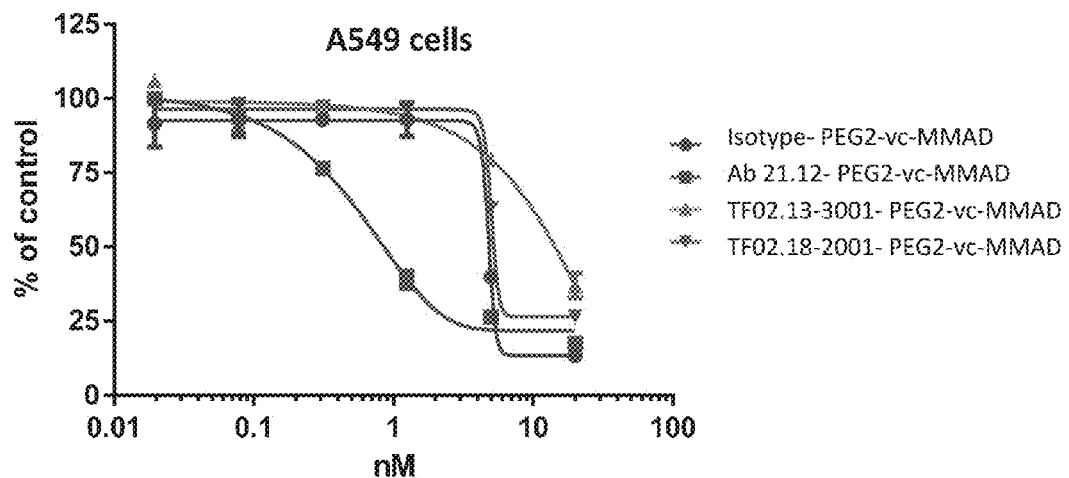
Figure 31E:
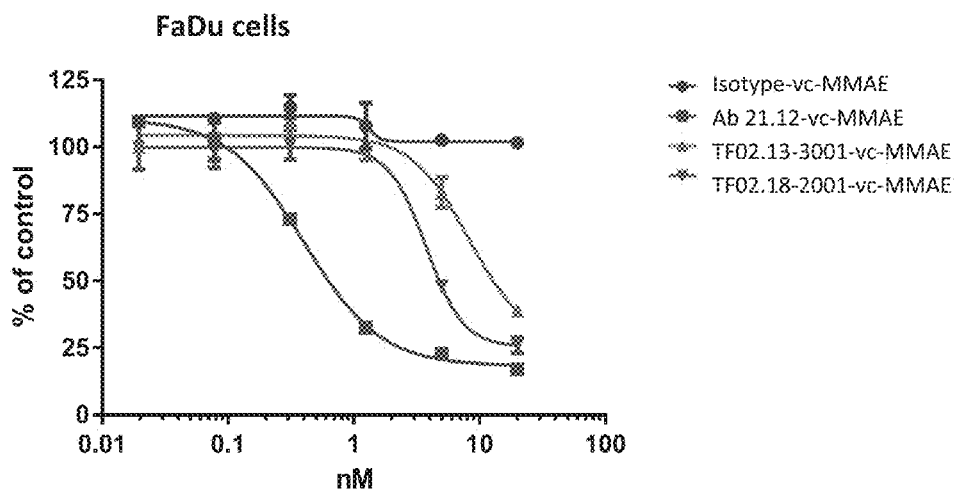
Figure 31F:
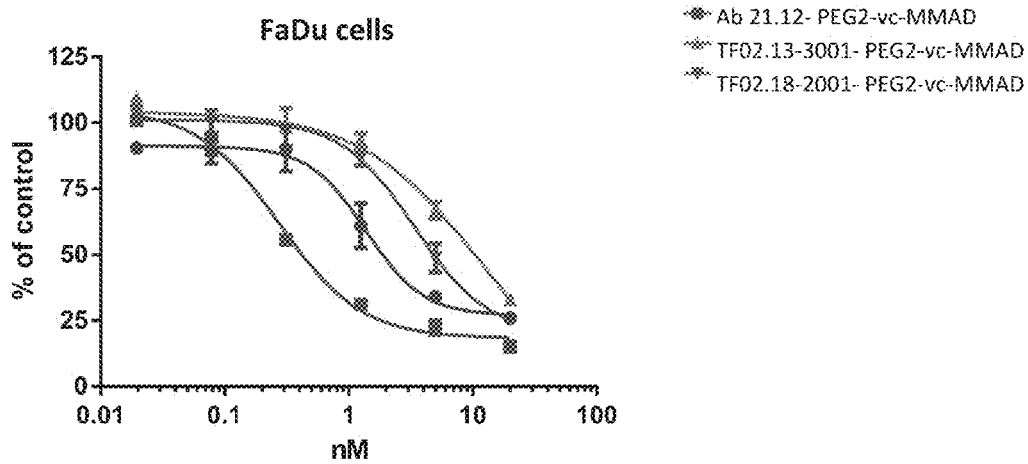
Figure 31G:
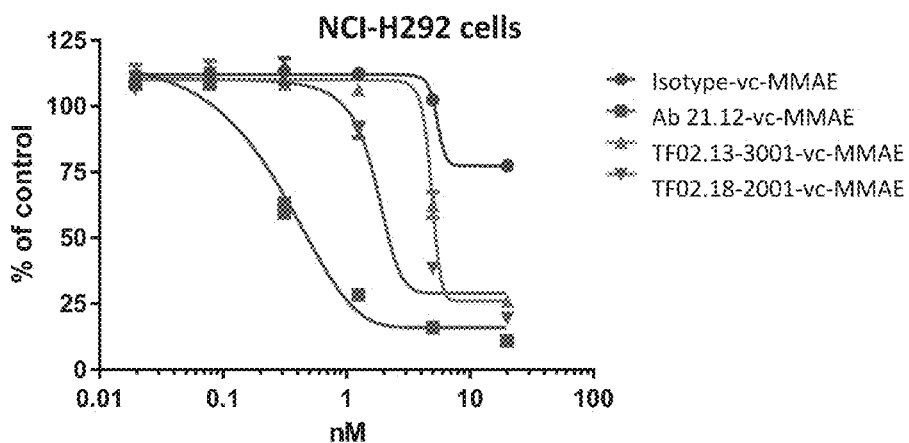
Figure 31H:
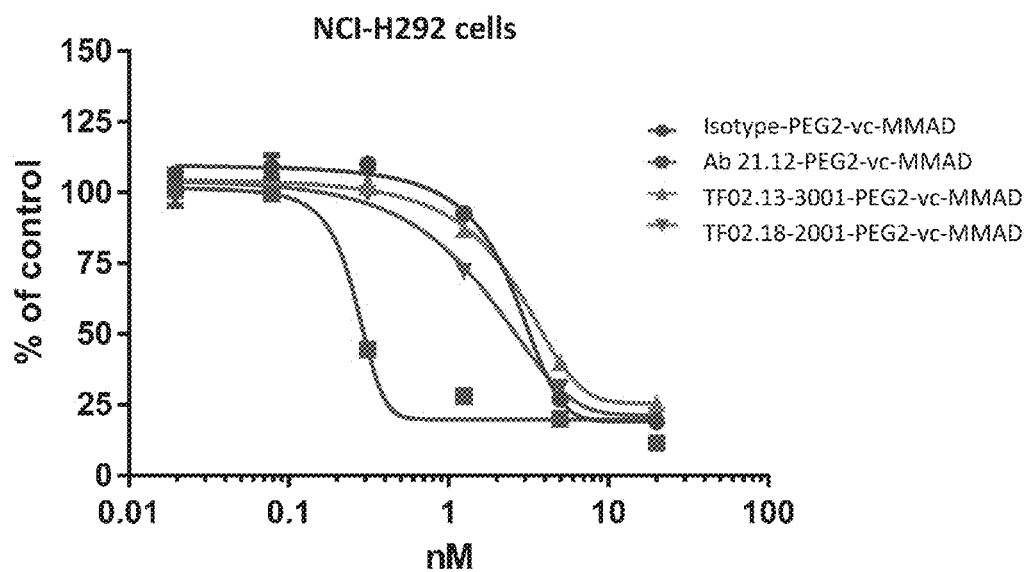
Figure 31I:
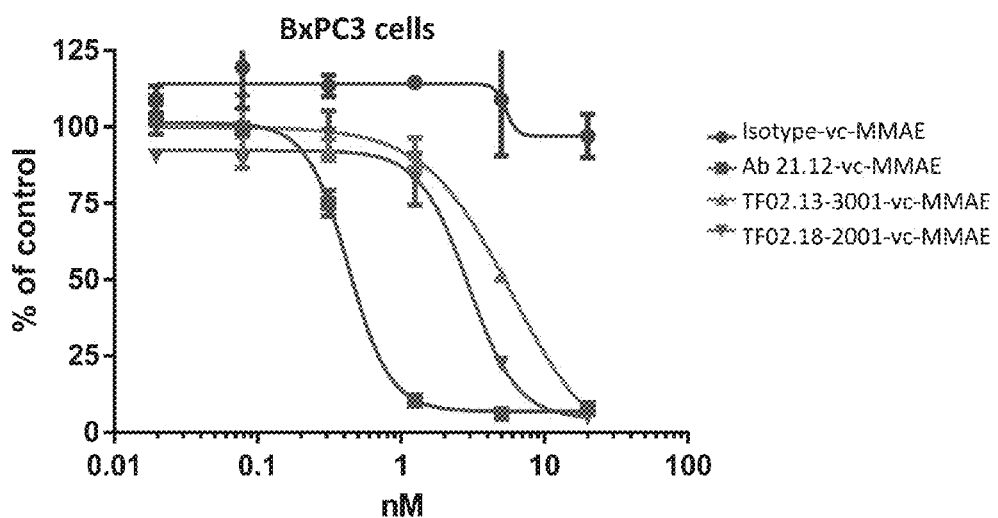
Figure 31J:
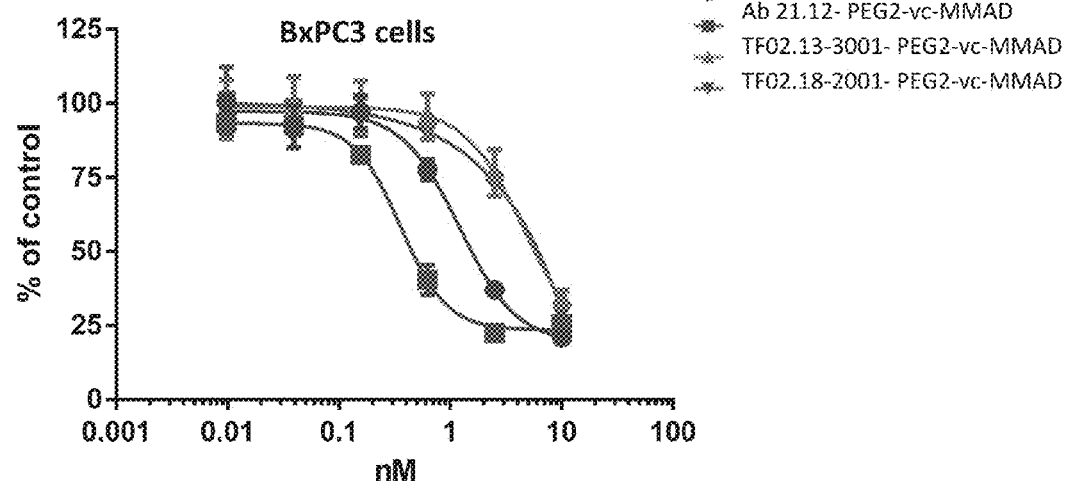

FIGS. 30C and 30C shows the amount of binding of anti-CD71 activatable antibodies and parental antibodies of the present disclosure to human CD71 in a solid-phase ELISA binding assay. In these examples, recombinant human CD71 protein (R&D Systems) was coated on copper or nickel-plated ELISA plates at a concentration of 1 µg/mL, and then incubated with the indicated concentration of an anti-CD71 antibody (anti-human CD71 Ab 21.12) or an activatable anti-CD71 antibody (anti-human CD71 TF02.13-3001, TF02.13-3007, TF02.13-3008, TF02.13-3011, TF02.13-3013, TF02.13-2001, TF02.13-2007, TF02.13-2008, TF02.13-2011, TF02.13-2012, TF02.13-2013), where in the activatable antibodies were assayed in their uncleaved form. The amount of bound antibody was detected by incubation and detection by goat anti-human antibody conjugated to horseradish peroxidase and Ultra TMB (Thermo Fisher Scientific) detection.

Table 21 below shows the equilibrium dissociation constants based on the binding curves depicted in FIGS. 30A to 30D. These results show that anti-human CD71 activatable antibodies and activatable antibody drug conjugates bind to the cell line and to the solid-phase bound CD71 at a significantly lower affinity than that of the parent anti-CD71 antibody, which is indicative of the masking efficiency of the masking moiety.

TABLE 21

Exemplary Observed CD71 Binding Activity of Anti-CD71 Binders

| Article | H292 Kd (nM) | ELISA Kd (nM) |
| --- | --- | --- |
| Ab 21.12 | 0.4412 | 0.2553 |
|  |  | 0.1624 |
| Isotype | ~22544 | — |
| TF02.13-3001 | 10.17 | 0.8132 |
| TF02.13-3007 | 86.66 | 2.210 |
| TF02.13-3008 | 97.79 | 2.613 |
| TF02.13-3011 | 67.36 | 0.7778 |
| TF02.13-3013 | 78.27 | 4.912 |
| TF02.13-2001 | 27.50 | 2.529 |
| TF02.13-2007 | 70.27 | — |
| TF02.13-2008 | 89.99 | 15.12 |
| TF02.13-2011 | 57.15 | 4.274 |
| TF02.13-2012 | 39.15 | 1.636 |
| TF02.13-2013 | 70.27 | 3.248 |

Example 27

Anti-CD71-AADC and ADC Cytotoxicity on Skin and Lung Cancer-Derived Cell Lines

This Example shows that anti-human CD71 antibody drug conjugates (ADCs) and activatable antibody drug conjugates (AADCs) of the present disclosure demonstrate a higher cytotoxicity against a lung adenocarcinoma and a skin squamous cell carcinoma-derived cell lines as compared to isotype-ADC controls.

FIGS. 31A-31J show that activatable antibody drug conjugates (AADCs) of the present disclosure conjugated to either PEG2-vc-MMAD, or vc-MMAE showed a lower cytotoxicity against a variety of cancer-derived cell lines than that of a correspondingly conjugated parental anti-CD71 antibody drug conjugate. The cancer-derived cell lines that were treated with the ADCs or AADCs were derived from a skin squamous cell carcinoma (A431, FIGS. 31A and 31B), a lung adenocarcinoma (A549, FIGS. 31C and 31D), a hypopharyngeal carcinoma (FaDu, FIGS. 31E and 31F), a non-small cell lung cancer (NCI-H292, FIGS. 31G and 31H), and a pancreatic adenocarcinoma (BxPC3, FIGS. 31I and 31J).

The anti-human CD71 ADCs demonstrated a similar cytotoxic efficacy to each other against the cell lines. The anti-human CD71 AADCs demonstrated a lower efficacy than the parental anti-CD71 ADC, which may be attributable to the masking effect of the masking moiety. In this study, the various anti-human CD71 ADCs or AADCs (TF02.13-3001 or TF02.18-2001 conjugated to the indicated drug) of the present disclosure and isotype drug conjugates were applied at the indicated concentrations to the cells. The cytotoxicity was determined as a percentage of a population of untreated cells that were used as a control.

Example 28

Anti-CD71 ADC Cytotoxicity on Various Cancer-Derived Cell Lines

This Example shows that anti-human CD71 antibody drug conjugates (ADCs) of the present disclosure demonstrate significant cytotoxicity against a variety of cancer-derived cell lines.

Table 23 shows the observed EC50s of an anti-CD71 antibody drug conjugate (ADCs) of the present disclosure conjugated to vc-MMAE. In this study, the anti-human CD71 Ab 21-12-vc-MMAE of the present disclosure was applied over a range of concentrations to the indicated cells. The cytotoxicity was determined as a percentage of a population of untreated cells that were used as a control, and an EC50 was calculated based on the observed cytotoxicity curve.

TABLE 23

Cytotoxicity EC50 of Anti-CD71-vc-MMAE

| Cancer Origin | Cell Line | EC50 (nM) |
| --- | --- | --- |
| Pancreatic Cancer | Miapaca2 | 0.2 |
|  | HPAF 2 | 0.2 |
|  | BxPC3 | 0.37 |
| Colorectal Cancer | SW480 | 0.11 |
|  | SW1417 | 0.17 |
|  | HT29 | 0.18 |
|  | Ls411N | 0.2 |
|  | SW48 | 0.2 |
|  | Ls174T | 0.23 |
|  | Lovo | 0.27 |
|  | HCT-116 | 0.54 |
|  | DLD1 | 1.76 |
|  | Fadu | 0.40 |
|  | A253 | 0.83 |
| Head-Neck Small Cell Carcinoma | SCC9 | 0.69 |
|  | KYSE 70 | 0.6 |
|  | SCC1 | 0.51 |
|  | KYSE 150 | 0.47 |
|  | SAS | 0.33 |
|  | BHY | 0.25 |
|  | SCC25 | 0.24 |

TABLE 23-continued

Cytotoxicity EC50 of Anti-CD71-vc-MMAE

| Cancer Origin | Cell Line | EC50 (nM) |
|---|---|---|
| | A431 | 0.22 |
| | NCI H292 | 0.3 |
| | Detroit 562 | 0.3 |
| Lung Cancer | A549 | 0.49 |
| | NCI H2141 | 0.5 |
| | NCI-H69 | 0.57 |
| | NCI H526 | 0.7 |
| | HS766T | 1.02 |
| | NCI H727 | 1.29 |
| | NCI H889 | 1.3 |
| Non-Hodgkin's | Ramos | 0.2 |
| Lymphoma | Raji | 0.3 |
| Ovarian Cancer | OVCAR3 | 0.20 |
| | ET201 | 0.49 |
| Breast Cancer | HCC1806 | 0.2 |
| | MDA MB231 | 1.1 |

Example 29

CD71 Expression on Small Cell Lung Cancer Cell Lines

This Example shows that CD71 antibody and antibody drug conjugates of the present disclosure bind CD71 on multiple small lung cancer cell lines (SCLC) essentially equivalently and specifically as shown by lack of binding of an isotype control or isotype control-ADC.

Figure 32A:
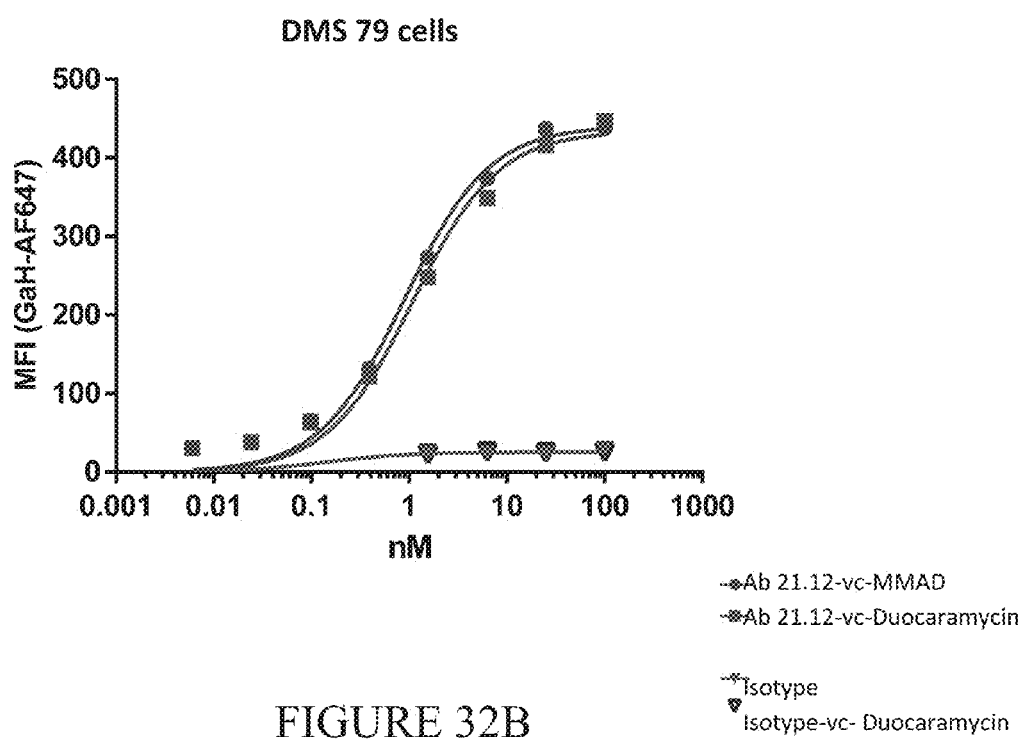
FIGS. 32A and 32B depict exemplary studies of the ability of anti-CD71 antibodies and antibody drug conjugates of the present disclosure to bind human CD71 on various human-derived small cell lung cancer cell lines.
Figure 32B:
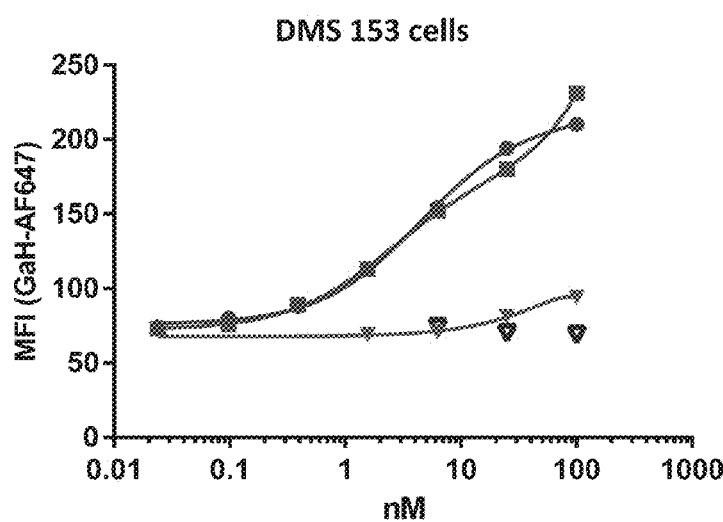

FIGS. 32A and 32B and Table 24 show the amount of binding of anti-CD71 antibodies and ADCs of the present disclosure to the SCLC cell lines DMS 79 and DMS 153. In this study, the binding of the antibodies and ADCs of the present disclosure to the indicated cell lines were performed using a standard FACS labelling method. Briefly, cells were labeled at the indicated concentrations with the indicated antibodies of the present disclosure: anti-human CD71 antibody (anti-human CD71 Ab21.12) or anti-human CD71 antibody conjugated to duocarmycin (anti-human CD71 Ab21.12-Duoc) or the corresponding isotype controls (pavilizumab) and subsequently detected with an Alexa Fluor 647 labeled goat anti-human IgG secondary antibody. Table 24 below shows the equilibrium dissociation constants based on the observed binding curves. These results show that anti-human CD71 21.12 antibody (CD71-Ab) and its corresponding ADC bound with essentially equivalent affinity.

TABLE 24

Exemplary Observed CD71 Binding Activity of Activatable Anti-CD71

| Test Article | DMS 79 Kd (nM) | DMS 153 Kd (nM) |
|---|---|---|
| Ab 21.12 | 0.8983 | 4.471 |
| Ab 21-12-Duoc | 1.087 | 2.298 |

Example 30

Anti-Proliferative Effect of Anti-CD71 Antibodies

This Example shows that anti-human CD71 antibodies of the present disclosure that bind CD71 on cancer cell lines demonstrate an anti-proliferative effect compared to an isotype control.

Figure 33A:
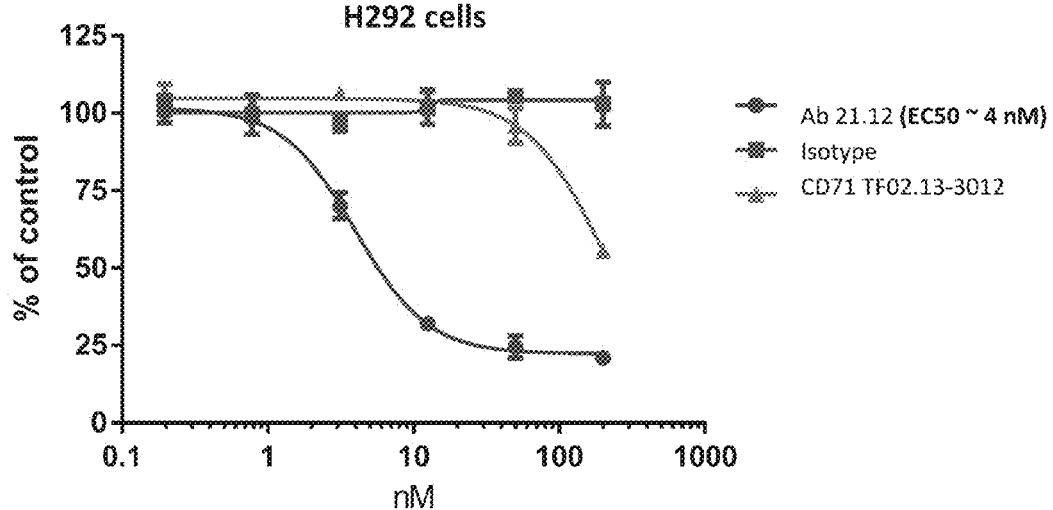
FIGS. 33A and 33B depict exemplary studies of the anti-proliferative effect of anti-CD71 antibodies of the present disclosure against various cancer-derived cell lines.
Figure 33B:
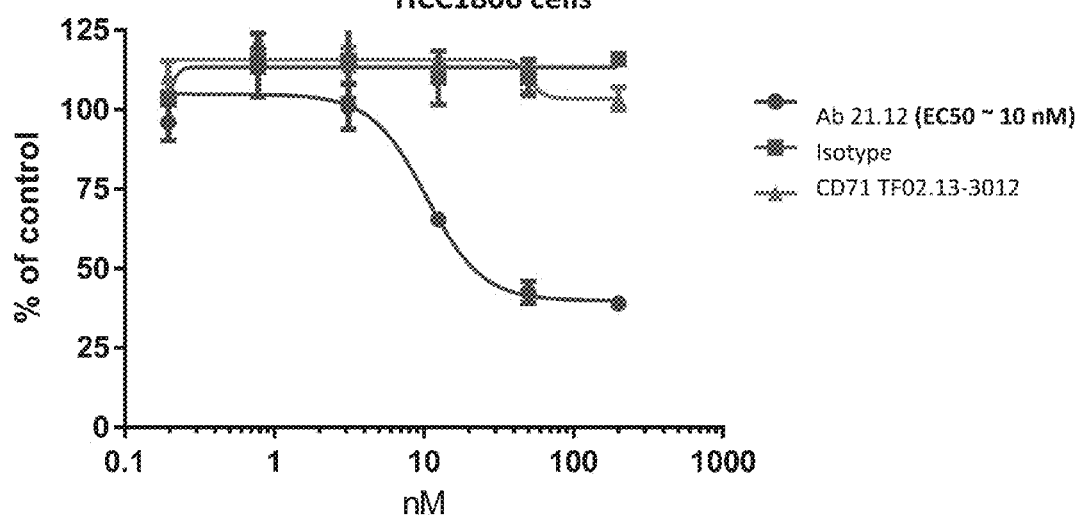

FIGS. 33A and 33B show the inhibition of cell proliferation by application of anti-CD71 Ab 21.12 antibody of the present disclosure to the H292 and HCC1806 cell lines, as compared to an isotype control. In this study, the indicated cells were plated at a density of 1000 cells per well in a 96 well plate and left to adhere overnight. An equal volume of test article at twice the indicated concentration was added and the plates were allowed to incubate for 5 days. Viability was subsequently measured using Cell Titer Glo reagent (Promega), and inhibition of proliferation was determined as a percentage of a population of untreated cells that were used as a control. The results indicate that anti-CD71 antibodies of the present disclosure showed significant inhibition of proliferation (EC50 of ~4 nM in H292 cells, and ~10 nM in HCC1806 cells)

Example 31

CD71 Expression in Multiple Metastatic Cancer Samples

This Example shows that CD71 is expressed in a large number and variety of patient-derived metastatic tumors by immunohistochemical (IHC) staining using an anti-CD71 antibody.

Figure 34:
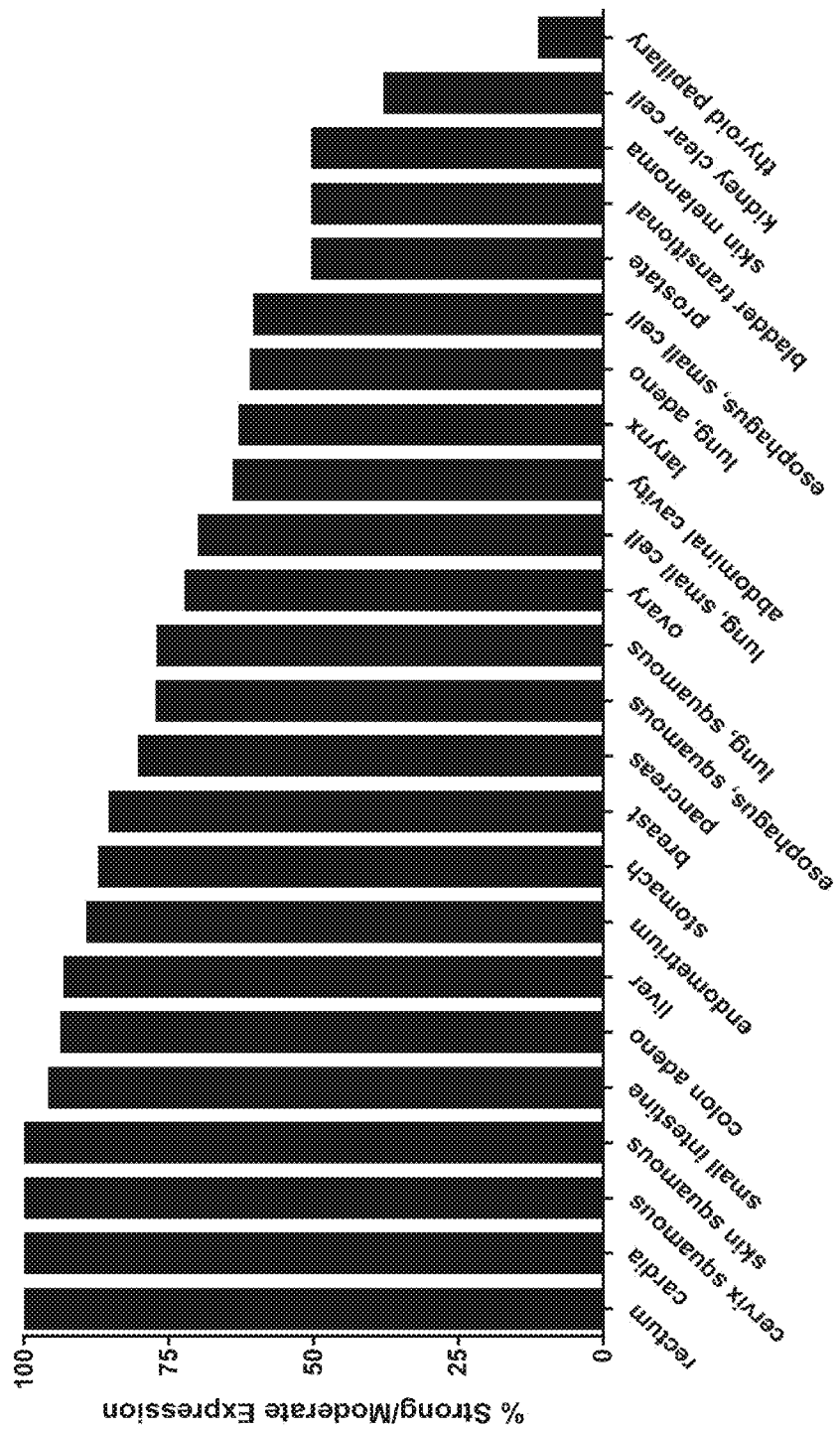
FIG. 34 depicts exemplary studies of the expression level of CD71 in multiple patient-derived metastatic cancer samples.

FIG. 34 shows that CD71 is moderately or highly expressed in a large number and variety of patient-derived metastatic tumor samples, using IHC staining with a commercially-purchased anti-CD71 antibody on multiple patient-derived tumor tissue microarrays (TMA). FIG. 34 shows a summary of the level of IHC staining of CD71 of the TMAs shows that a large number of cores derived from multiple patient-derived metastatic samples showed a strong CD71 signal.

Example 32

In Vivo Imaging of Activatable Anti-CD71 Antibodies in a Mouse Pancreatic Cancer Xenograft Model This Example shows that activatable anti-CD71 antibodies of the present disclosure demonstrate tumor-associated protease-dependent in vivo activation and binding to CD71 expressed in a pancreatic cancer mouse xenograft model by in vivo fluorescent imaging.

Figure 35:
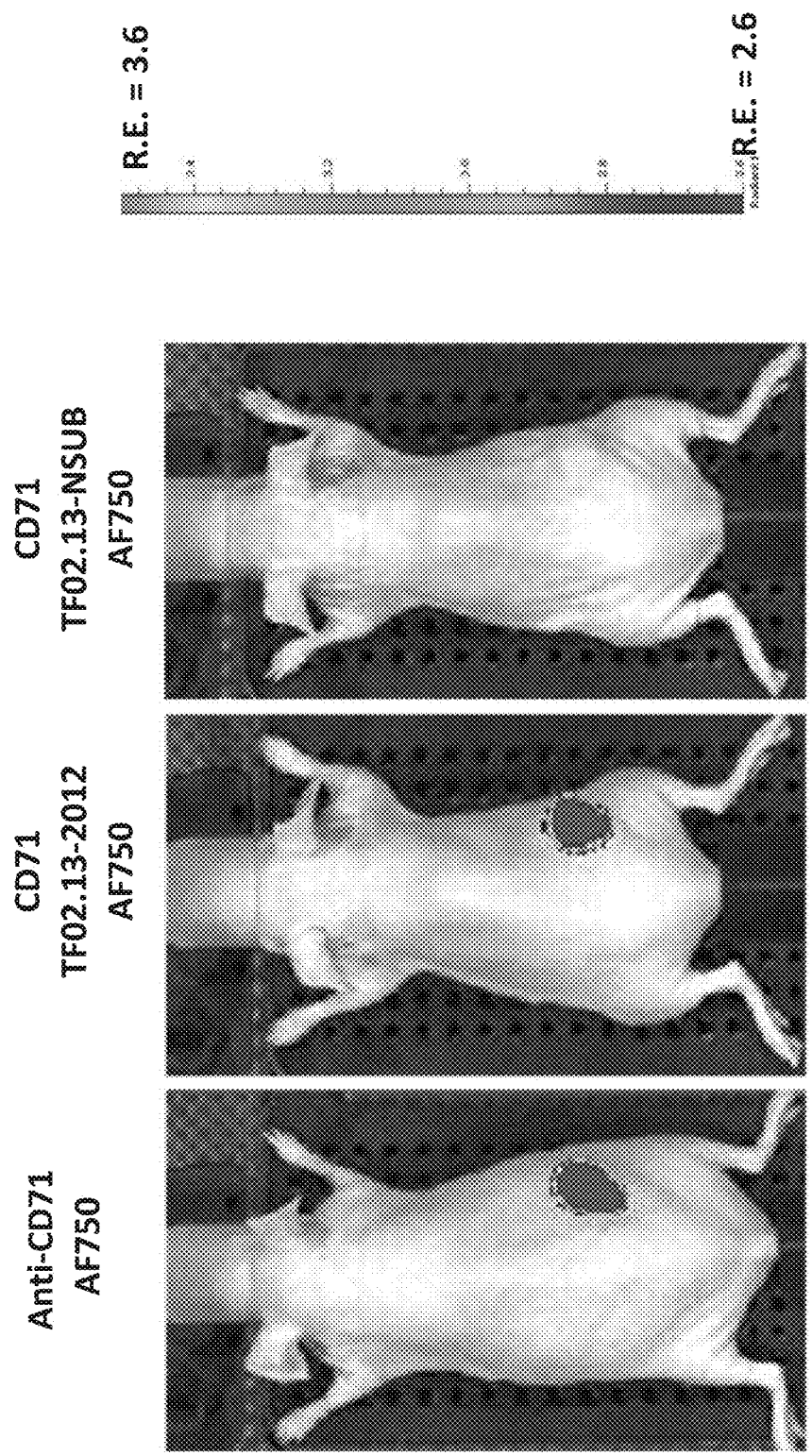
FIG. 35 depicts exemplary studies of in vivo binding of anti-CD71 antibodies of the present disclosure to tumors in a pancreatic cancer mouse model.

FIG. 35 shows in vivo imaging of live mice with pancreatic tumor xenografts (BxPC3 cells) using fluorescently-conjugated anti-CD71 and activatable anti-CD71 antibodies of the present disclosure. In this study, 7-8 week-old nu/nu female mice were implanted subcutaneously in the right hind flank with $5 \times 10^6$ BxPC3 cells, a human pancreatic cancer-derived cell line. After the tumors grew to 300 to 380 $mm^3$, an anti-CD71 antibody Ab 21.12 of the present disclosure ("anti-CD71"), an activatable anti-CD71 antibody of the present disclosure ("CD71 TF02.13-2012"), or a masked anti-CD71 antibody of the present disclosure lacking a CM domain ("CD71 TF02.13-NSUB") were administered to each of the mice at a dose of 1 mg/kg. The administered antibodies were labeled by conjugation to the fluorescent label AlexFluor 750. The mice were subjected to in vivo fluorescent imaging 96 hours after administration of the antibodies, using a 745 nm excitation signal and detecting an 800 nm emission signal. The scale shows the relative magnitude of the detected fluorescent signal.

The results of this exemplary study showed that fluorescent signals from the labeled unmasked anti-CD71 antibody of the present disclosure and the labeled activatable anti-CD71 antibody of the present disclosure accumulated in the xenograft. In contrast, a correspondingly masked anti-CD71 antibody but which lacked a protease cleavage site (CM) did not detectably accumulate in its tumor xenograft site. Without being bound by any particular theory, this exemplary study demonstrated that activatable anti-CD71 antibodies of the present disclosure can be activated in vivo via tumor-associated protease cleavage, thus allowing the activated activatable anti-CD71 antibody to bind CD71 in the xenograft tumor to an extent comparable to the unmasked anti-CD71 antibody of the present disclosure. The masked anti-CD71 antibody lacking a protease cleavage domain (CM) of the present disclosure was not activatable in the same manner, and thus did not appreciably bind to the tumor xenograft.

Example 33

In Vivo Imaging of Activatable Anti-CD71 Antibodies in a Mouse Model of Breast Cancer Metastasis This Example shows that activatable anti-CD71 antibodies of the present disclosure demonstrate tumor-associated protease-dependent in vivo activation and binding to CD71 expressed in a mouse model of breast cancer metastasis by in vivo imaging.

Figure 36:
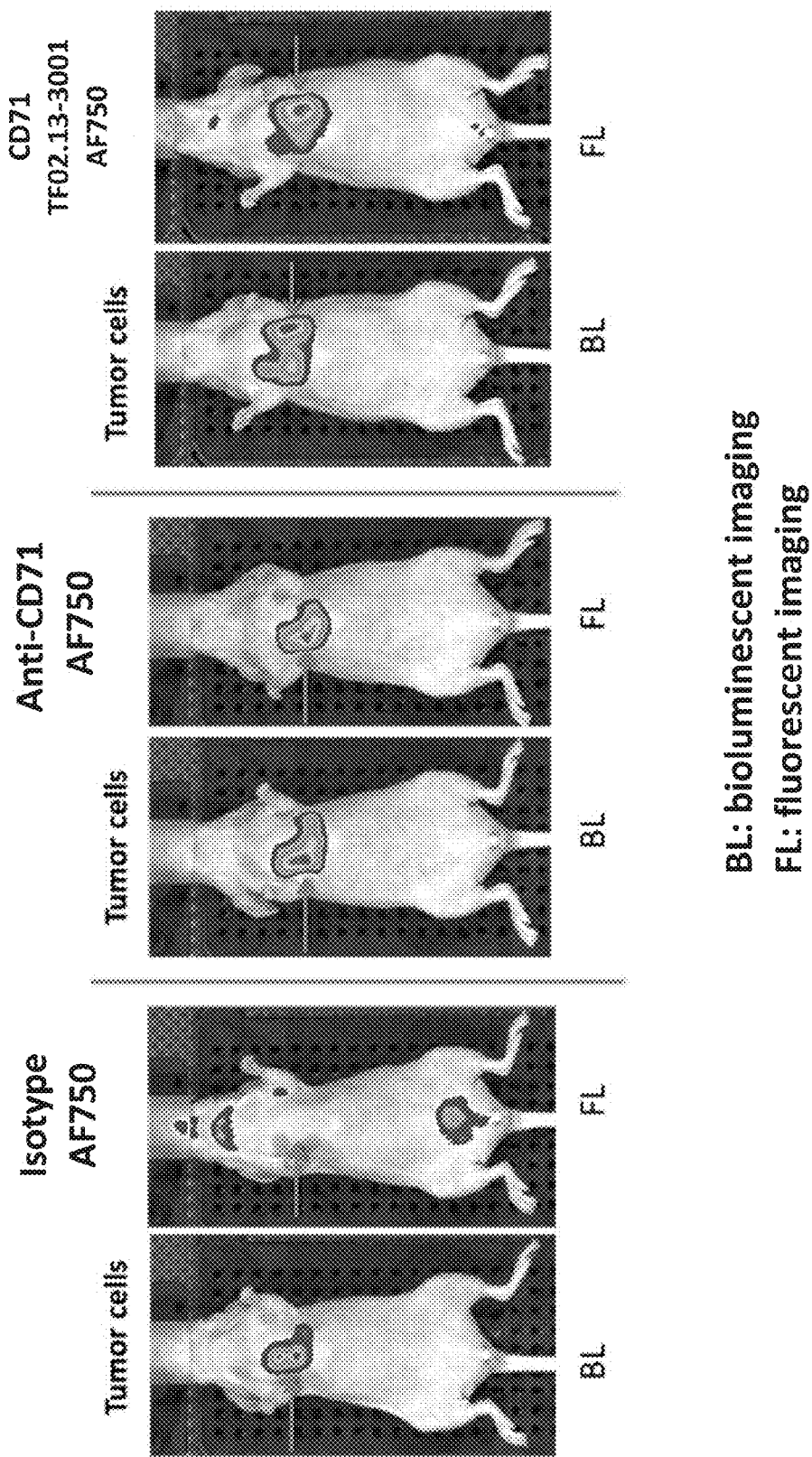
FIG. 36 depicts exemplary studies of in vivo binding of anti-CD71 antibodies of the present disclosure to tumors in a metastatic breast cancer mouse model.

FIG. 36 shows in vivo imaging of live mice with a human-derived breast cancer metastatic cancer model, using fluorescently-conjugated anti-CD71 and activatable anti-CD71 antibodies of the present disclosure, and in which the cancer cells also express a bioluminescent signal. In this study, 7-8 week-old nu/nu female mice were injected into the left ventricle with $5 \times 10^5$ MDA-MB-231-luc2-D3LN cells, a human breast cancer-derived cell line that expresses the bioluminescent enzyme luciferase. Mice with detectable cancer cells (as determined by detecting a bioluminescent signal via in vivo imaging) received a 5 mg/kg intravenous injection of an isotype control antibody palivizumab ("isotype"), an anti-CD71 antibody Ab21.12 of the present disclosure ("anti-CD71"), or an activatable antibody of the present disclosure ("CD71 TF02.13-3001"). The administered antibodies were labeled by conjugation to the fluorescent label AlexFluor 750. The mice were subjected to in vivo fluorescent imaging 48 hours after administration of the antibodies, using a 745 nm excitation signal and detecting an 800 nm emission signal. Following fluorescent imaging of the antibodies, the mice were injected intraperitoneally with 3 mg luciferin, and then subjected to in vivo bioluminescent imaging 10 minutes post-injection by blocked excitation and open emission.

The results of this exemplary study showed that fluorescent signals from the labeled unmasked anti-CD71 antibody of the present disclosure and the labeled activatable anti-CD71 antibody of the present disclosure accumulated in the same location as the tumor location, as determined by the overlapping bioluminescent and fluorescent signals. In contrast, a correspondingly labeled isotype control antibody did not detectably accumulate at or near any tumor site. Without being bound by any particular theory, this exemplary study demonstrated that activatable anti-CD71 antibodies of the present disclosure can be activated in vivo via tumor-associated protease cleavage, thus allowing the activated activatable anti-CD71 antibody to bind CD71 in the metastatic tumor model to an extent comparable to the unmasked anti-CD71 antibody of the present disclosure.

Example 34

In Situ Imaging of Activatable Anti-CD71 Antibodies

This Example shows that activatable anti-CD71 antibodies of the present disclosure demonstrate tumor-dependent in situ activation and binding to CD71 expressed in a non-small cell lung cancer (NSCLC) mouse xenograft model by immunohistochemical (IHC) staining.

Figure 37:
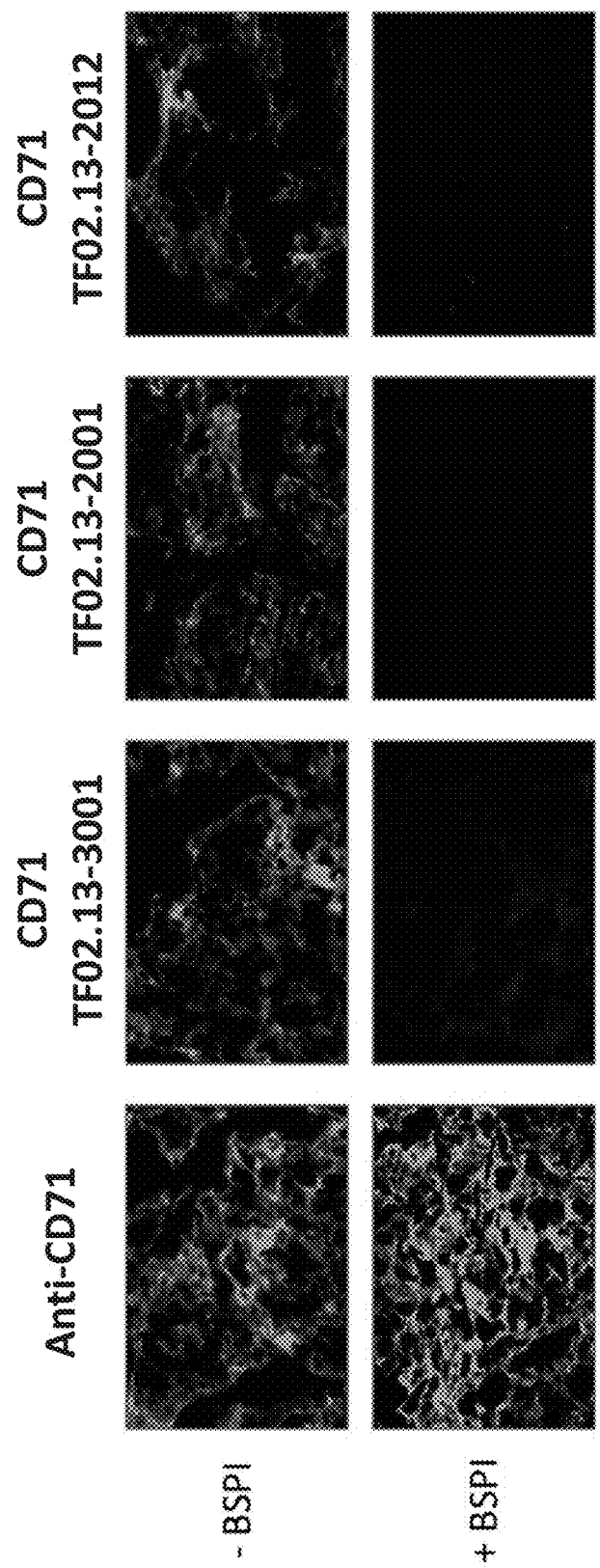
FIG. 37 depicts exemplary studies of in situ binding of anti-CD71 antibodies of the present disclosure in a lung cancer xenograft model.

FIG. 37 shows an IHC staining assay of tissues sections of H292 NSCLC xenograft tumors using anti-CD71 and activatable anti-CD71 antibodies of the present disclosure. In this study, tissue sections from H292 xenograft tumors were pre-incubated either in the presence (+BSPI) or absence (−BSPI) of a broad-spectrum protease inhibitor cocktail (Protease Inhibitor Cocktail Set III, EDTA-Free (Cat. No. 539134, EMD Millipore) at a 1:15 dilution and 20 mM EDTA in Tris buffer). The tissue sections were then incubated for 2 hours at room temperature with either anti-CD71 antibody Ab 21.12 of the present disclosure ("anti-CD71") or activatable anti-CD71 antibodies of the present disclosure ("CD71 TF02.13-3001", "CD71 TF02.13-2001", or "CD71 TF02.13-2012"). After extensive washing to remove non-bound material, the presence of bound anti-CD71 antibodies or activated anti-CD71 antibodies of the present disclosure were detected with donkey anti-human IgG secondary antibody labeled with AlexaFluor 647 (Cat. No. 709-605-149, Jackson ImmunoResearch). Without being bound by any particular theory, this exemplary study shows that activatable anti-CD71 antibodies of the present disclosure demonstrated in situ activation and binding to CD71 in the xenograft tissue sections, which was inhibited by the pre-incubation of the tissues with a broad spectrum of protease inhibitors. The unmasked anti-CD71 antibody of the present disclosure demonstrated in situ binding to CD71 in the xenograft tissue sections irrespective of the presence or absence of protease-inhibitor pre-incubation.

Other Embodiments

While the invention has been described in conjunction with the detailed description thereof, the foregoing description is intended to illustrate and not limit the scope of the invention, which is defined by the scope of the appended claims. Other aspects, advantages, and modifications are within the scope of the following.

SEQUENCE LISTING (1037 sequences)

SEQ ID NO: 1 - protein, 118 aa, Artificial Sequence
  chemically synthesized
EVQLQESGTVLARPGASVKMSCKASGYTFTSYWMHWVKQRPGQGLEWIGAIYPGNSETGYNQNFKGKAKLTAVTSASTAYMDLSSLTNEDSAVYYCTRENWDPGFAFWGQGTLITVSA

SEQ ID NO: 2 - protein, 108 aa, Artificial Sequence
  chemically synthesized
DIVMTQTPAIMSASPGEKVTITCSASSSVYYMYWFQQKPGTSPKLWIYSTSNLASGVPVRFSGSGSGTSYSLTISRMEAEDAATYYCQQRRNYPYTFGGGTKLEIKRA

SEQ ID NO: 3 - protein, 118 aa, Artificial Sequence
  chemically synthesized
QVQLVQSGAEVKKPGASVKVSCKASGYTFTSYWMHWVRQAPGQGLEWMGAIYPGNSETGYAQKFQGRVTMTRDTSTSTVYMELSSLRSEDTAVYYCARENWDPGFAFWGQGTLVTVSS

SEQ ID NO: 4 - protein, 118 aa, Artificial Sequence
  chemically synthesized
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLVTVSS

SEQ ID NO: 5 - protein, 118 aa, Artificial Sequence
  chemically synthesized
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLITVSS

SEQ ID NO: 6 - protein, 106 aa, Artificial Sequence
  chemically synthesized
DIQMTQSPSSLSASVGDRVTITCSASSSVYYMYWYQQKPGKAPKLLIYSTSNLASGVPSRFSGSGSGTDFTLTISSLQPEDFATYYCQQRRNYPYTFGQGTKLEIK

SEQ ID NO: 7 - protein, 106 aa, Artificial Sequence
  chemically synthesized
DIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 8 - protein, 106 aa, Artificial Sequence
  chemically synthesized
DIQMTQSPSSLSASVGDRVTITCRASSSVYYMYWFQQKPGKAPKLWIYSTSNLASGVPSRFSGSGSGTDYTLTISSMQPEDFATYYCQQRRNYPYTFGQGTKLEIK

SEQ ID NO: 9 - protein, 10 aa, Artificial Sequence
  chemically synthesized
GYTFTSYWMH

SEQ ID NO: 10 - protein, 10 aa, Artificial Sequence
  chemically synthesized
AIYPGNSETG

SEQ ID NO: 11 - protein, 9 aa, Artificial Sequence
  chemically synthesized
ENWDPGFAF

SEQ ID NO: 12 - protein, 10 aa, Artificial Sequence
  chemically synthesized
SASSSVYYMY

SEQ ID NO: 13 - protein, 11 aa, Artificial Sequence
  chemically synthesized
CRASSSVYYMY

SEQ ID NO: 14 - protein, 7 aa, Artificial Sequence
  chemically synthesized
STSNLAS

SEQ ID NO: 15 - protein, 9 aa, Artificial Sequence
  chemically synthesized
QQRRNYPYT

SEQ ID NO: 16 - protein, 15 aa, Artificial Sequence
  chemically synthesized
QFCPWSYYLIGDCDI

SEQ ID NO: 17 - protein, 15 aa, Artificial Sequence
  chemically synthesized
NLCTEHSFALDCRSY

SEQ ID NO: 18 - protein, 15 aa, Artificial Sequence
  chemically synthesized
APMPCTSPGCWLTLR

SEQ ID NO: 19 - protein, 15 aa, Artificial Sequence
  chemically synthesized
QSACIFPMTNSCTYS

SEQ ID NO: 20 - protein, 15 aa, Artificial Sequence
  chemically synthesized
ASQFCTANPECNYAG

SEQ ID NO: 21 - protein, 15 aa, Artificial Sequence
  chemically synthesized
THRCLPMQNFCHNPF

SEQ ID NO: 22 - protein, 15 aa, Artificial Sequence
  chemically synthesized
ICSFESWHQFSNCNP

SEQ ID NO: 23 - protein, 15 aa, Artificial Sequence
  chemically synthesized
RYSPACYSTCNSINW

SEQ ID NO: 24 - protein, 15 aa, Artificial Sequence
  chemically synthesized
NRWCAPMQNYCHHST

SEQ ID NO: 25 - protein, 15 aa, Artificial Sequence
  chemically synthesized
AHCVQMSNHPYCNHG

SEQ ID NO: 26 - protein, 15 aa, Artificial Sequence
  chemically synthesized
LSHVCLITPMCNAMQ

SEQ ID NO: 27 - protein, 15 aa, Artificial Sequence
  chemically synthesized
AWWCAPMQNACQHYQ

SEQ ID NO: 28 - protein, 15 aa, Artificial Sequence
  chemically synthesized
RSPCAVPMSNSCYII

SEQ ID NO: 29 - protein, 15 aa, Artificial Sequence
  chemically synthesized
STRCLPMQNYCHFSD

SEQ ID NO: 30 - protein, 15 aa, Artificial Sequence
  chemically synthesized
PNCLPMQNAQRCHSP

SEQ ID NO: 31 - protein, 15 aa, Artificial Sequence
  chemically synthesized
NTAFCTHNPFCNRPT

SEQ ID NO: 32 - protein, 15 aa, Artificial Sequence
  chemically synthesized
MYSPYCYSMCNNIYP

SEQ ID NO: 33 - protein, 15 aa, Artificial Sequence
  chemically synthesized
IMRSCTSPGCYLYNT

SEQ ID NO: 34 - protein, 15 aa, Artificial Sequence
  chemically synthesized
TRCFPMSNNPNCMNY

SEQ ID NO: 35 - protein, 15 aa, Artificial Sequence
  chemically synthesized
NCGNFYYTMMANCNY

SEQ ID NO: 36 - protein, 15 aa, Artificial Sequence
  chemically synthesized
NPNCWAPMMNSCNAF

SEQ ID NO: 37 - protein, 15 aa, Artificial Sequence
  chemically synthesized
WNCENVNLYLPACMQ

SEQ ID NO: 38 - protein, 15 aa, Artificial Sequence
  chemically synthesized
TWCPPMSNHPTCTLK

SEQ ID NO: 39 - protein, 15 aa, Artificial Sequence
  chemically synthesized
GYPCVPMQNRCAWKS

SEQ ID NO: 40 - protein, 15 aa, Artificial Sequence
  chemically synthesized
LLSPFCTQMCNPKLQ

SEQ ID NO: 41 - protein, 15 aa, Artificial Sequence
  chemically synthesized
MSRFCTHNPECNFTY

SEQ ID NO: 42 - protein, 15 aa, Artificial Sequence
  chemically synthesized
MSTCWTQMTNRCTYN

SEQ ID NO: 43 - protein, 15 aa, Artificial Sequence
  chemically synthesized
RKSPNCYSMCNYYFN

SEQ ID NO: 44 - protein, 15 aa, Artificial Sequence
  chemically synthesized
TGQCWAPMQNCTHNK

SEQ ID NO: 45 - protein, 15 aa, Artificial Sequence
  chemically synthesized
TKMGCSKANLCNGAM

SEQ ID NO: 46 - protein, 15 aa, Artificial Sequence
  chemically synthesized
AHWCAPMQNRCTNAP

SEQ ID NO: 47 - protein, 15 aa, Artificial Sequence
  chemically synthesized
ASCPLMSNKPTCRQP

SEQ ID NO: 48 - protein, 15 aa, Artificial Sequence
  chemically synthesized
DQCWAPMMNNFHCNK

SEQ ID NO: 49 - protein, 15 aa, Artificial Sequence
  chemically synthesized
EYCEYTRPVPMGCWG

SEQ ID NO: 50 - protein, 15 aa, Artificial Sequence
  chemically synthesized
GMCPLMSNNPNCNNY

SEQ ID NO: 51 - protein, 15 aa, Artificial Sequence
  chemically synthesized
GSCPLMSNRPSCHSS

SEQ ID NO: 52 - protein, 15 aa, Artificial Sequence
  chemically synthesized
HGDCAPMTNRCTNTT

SEQ ID NO: 53 - protein, 15 aa, Artificial Sequence
  chemically synthesized
KLPCWTLHQNSCTEY

SEQ ID NO: 54 - protein, 15 aa, Artificial Sequence
  chemically synthesized
LASCAPMQNRCYGLN

SEQ ID NO: 55 - protein, 15 aa, Artificial Sequence
  chemically synthesized
MDRFGCLQMCNWPKN

SEQ ID NO: 56 - protein, 15 aa, Artificial Sequence
  chemically synthesized
MMHCAMMQNRCSEYH

SEQ ID NO: 57 - protein, 15 aa, Artificial Sequence
  chemically synthesized
MRSCHSPMMNQCNHI

SEQ ID NO: 58 - protein, 15 aa, Artificial Sequence
  chemically synthesized
MTHCLPMQNRCTTYM

SEQ ID NO: 59 - protein, 15 aa, Artificial Sequence
  chemically synthesized
QSKCWTTMMNGCHIN

SEQ ID NO: 60 - protein, 15 aa, Artificial Sequence
  chemically synthesized
RECMPMQNNPACHMY

SEQ ID NO: 61 - protein, 15 aa, Artificial Sequence
  chemically synthesized
RPSPACKIMCNMYQH

SEQ ID NO: 62 - protein, 15 aa, Artificial Sequence
  chemically synthesized
SNRCWAPMTNMCTYN

SEQ ID NO: 63 - protein, 15 aa, Artificial Sequence
  chemically synthesized
SRKCFPMENRCNHHT

SEQ ID NO: 64 - protein, 15 aa, Artificial Sequence
  chemically synthesized
TPFCLPMQNSCKHTS

SEQ ID NO: 65 - protein, 15 aa, Artificial Sequence
  chemically synthesized
TTHCMPMQNKCNRPN

SEQ ID NO: 66 - protein, 15 aa, Artificial Sequence
  chemically synthesized
TTSCIMPMTNRCTIH

SEQ ID NO: 67 - protein, 15 aa, Artificial Sequence
  chemically synthesized
VYSPLCHNMCNPRNT

SEQ ID NO: 68 - protein, 15 aa, Artificial Sequence
  chemically synthesized
WCNNRYIAPMSNCAS

SEQ ID NO: 69 - protein, 15 aa, Artificial Sequence
  chemically synthesized
WEYCHNTEFIGCTYK

SEQ ID NO: 70 - protein, 15 aa, Artificial Sequence
  chemically synthesized
WTSFCTHNIFCNMNG

SEQ ID NO: 71 - protein, 15 aa, Artificial Sequence
  chemically synthesized
YLRGCYEYNMCNGYY

SEQ ID NO: 72 - protein, 15 aa, Artificial Sequence
  chemically synthesized
YSCAPMQNHPQCNQT

SEQ ID NO: 73 - protein, 15 aa, Artificial Sequence
  chemically synthesized
ACVNSNYPFDSNCMY

SEQ ID NO: 74 - protein, 15 aa, Artificial Sequence
  chemically synthesized
ADCQIFAMTNRCMNN

SEQ ID NO: 75 - protein, 15 aa, Artificial Sequence
  chemically synthesized
AECSPMSNRPQCHIH

SEQ ID NO: 76 - protein, 15 aa, Artificial Sequence
  chemically synthesized
AISCMPMQNSCYHTY

SEQ ID NO: 77 - protein, 15 aa, Artificial Sequence
  chemically synthesized
AKCWTEYMNHPECRI

SEQ ID NO: 78 - protein, 15 aa, Artificial Sequence
  chemically synthesized
ALHVLCYNFCNGPTT

SEQ ID NO: 79 - protein, 15 aa, Artificial Sequence
  chemically synthesized
AMCVGCSRECCWLGK

SEQ ID NO: 80 - protein, 15 aa, Artificial Sequence
  chemically synthesized
AQPCAPMQNSCHQSV

SEQ ID NO: 81 - protein, 15 aa, Artificial Sequence
  chemically synthesized
ARLGCTKFNMCNFYS

SEQ ID NO: 82 - protein, 15 aa, Artificial Sequence
  chemically synthesized
ASCPLMSNKPQCLKH

SEQ ID NO: 83 - protein, 15 aa, Artificial Sequence
  chemically synthesized
ASTFCTHNPACAYIP

SEQ ID NO: 84 - protein, 15 aa, Artificial Sequence
  chemically synthesized
ATCPLMSNRPSCISA

SEQ ID NO: 85 - protein, 15 aa, Artificial Sequence
  chemically synthesized
ATSMYCYSMCNTNNY

SEQ ID NO: 86 - protein, 15 aa, Artificial Sequence
  chemically synthesized
AYRCMPMQNSCYSTN

SEQ ID NO: 87 - protein, 15 aa, Artificial Sequence
  chemically synthesized
AYTGCTANNMCNAAY

SEQ ID NO: 88 - protein, 15 aa, Artificial Sequence
  chemically synthesized
CASLCKNQPCSSNRN

SEQ ID NO: 89 - protein, 15 aa, Artificial Sequence
  chemically synthesized
DCPMSYYLPMVNCMH

SEQ ID NO: 90 - protein, 15 aa, Artificial Sequence
  chemically synthesized
DCWRYLGNMNNWCYL

SEQ ID NO: 91 - protein, 15 aa, Artificial Sequence
  chemically synthesized
DLTFCTANPFCSREF

SEQ ID NO: 92 - protein, 15 aa, Artificial Sequence
  chemically synthesized
DNSFCTHNYYCMLNK

SEQ ID NO: 93 - protein, 15 aa, Artificial Sequence
  chemically synthesized
DSRCWTGHQNRCNTI

SEQ ID NO: 94 - protein, 15 aa, Artificial Sequence
  chemically synthesized
EACMHSLHWRSWCKV

SEQ ID NO: 95 - protein, 15 aa, Artificial Sequence
  chemically synthesized
ECENLYKAPMENCLR

SEQ ID NO: 96 - protein, 15 aa, Artificial Sequence
  chemically synthesized
ECRLRNQPMMSNCSM

SEQ ID NO: 97 - protein, 15 aa, Artificial Sequence
  chemically synthesized
EHPCMPMENRCYTLN

SEQ ID NO: 98 - protein, 15 aa, Artificial Sequence
  chemically synthesized
ESVCMPMQNVCTWTT

SEQ ID NO: 99 - protein, 15 aa, Artificial Sequence
  chemically synthesized
EYCNMIPMTNYCSYN

SEQ ID NO: 100 - protein, 15 aa, Artificial Sequence
  chemically synthesized
EYLWCELMVSCSRLM

SEQ ID NO: 101 - protein, 15 aa, Artificial Sequence
  chemically synthesized
FKHFCTHNPECKYNT

SEQ ID NO: 102 - protein, 15 aa, Artificial Sequence
  chemically synthesized
FPQCSPMQNKCGEGR

SEQ ID NO: 103 - protein, 15 aa, Artificial Sequence
  chemically synthesized
FRSQYCQSMCNYYNN

SEQ ID NO: 104 - protein, 15 aa, Artificial Sequence
  chemically synthesized
FRWCAPMQNYCHHST

SEQ ID NO: 105 - protein, 15 aa, Artificial Sequence
  chemically synthesized
FSCTAMSYAEDCWSW

SEQ ID NO: 106 - protein, 15 aa, Artificial Sequence
  chemically synthesized
FSQGCFHDNMCNRYQ

SEQ ID NO: 107 - protein, 15 aa, Artificial Sequence
  chemically synthesized
GCFQLCETCCIHSFD

SEQ ID NO: 108 - protein, 15 aa, Artificial Sequence
  chemically synthesized
GGHCAPMQNNCYYNS

SEQ ID NO: 109 - protein, 15 aa, Artificial Sequence
  chemically synthesized
GKYCKMPMVNRCYIM

SEQ ID NO: 110 - protein, 15 aa, Artificial Sequence
  chemically synthesized
GMYCTRMQNSCAHNN

SEQ ID NO: 111 - protein, 15 aa, Artificial Sequence
  chemically synthesized
GPFFCTHSPECQFDK

SEQ ID NO: 112 - protein, 15 aa, Artificial Sequence
  chemically synthesized
GQCFCSSLFCRPLKP

SEQ ID NO: 113 - protein, 15 aa, Artificial Sequence
  chemically synthesized
GQYCNLPMVNSCNYL

SEQ ID NO: 114 - protein, 15 aa, Artificial Sequence
  chemically synthesized
GRSCWTSFMNRCTND

SEQ ID NO: 115 - protein, 15 aa, Artificial Sequence
  chemically synthesized
GTCSWGSPGGQLCGR

SEQ ID NO: 116 - protein, 15 aa, Artificial Sequence
  chemically synthesized
GVCLLGLETYLLCFS

SEQ ID NO: 117 - protein, 15 aa, Artificial Sequence
  chemically synthesized
GWSYCINIYCRIDDN

SEQ ID NO: 118 - protein, 15 aa, Artificial Sequence
  chemically synthesized
HCANHHPTPMQNCKT

SEQ ID NO: 119 - protein, 15 aa, Artificial Sequence
  chemically synthesized
HCKEAPWTLYMNCNT

SEQ ID NO: 120 - protein, 15 aa, Artificial Sequence
  chemically synthesized
HCWWPQNIPMNNCIS

SEQ ID NO: 121 - protein, 15 aa, Artificial Sequence
  chemically synthesized
HFCQNHWQMVNACTA

SEQ ID NO: 122 - protein, 15 aa, Artificial Sequence
  chemically synthesized
HGQCMPMQNRCSNSY

SEQ ID NO: 123 - protein, 15 aa, Artificial Sequence
  chemically synthesized
HISPYCQQMCNKWYN

SEQ ID NO: 124 - protein, 15 aa, Artificial Sequence
  chemically synthesized
HLMECSYENMCNRYY

SEQ ID NO: 125 - protein, 15 aa, Artificial Sequence
  chemically synthesized
HMYCAPMQNACTKNT

SEQ ID NO: 126 - protein, 15 aa, Artificial Sequence
  chemically synthesized
HNCWTMMMNKPYCSN

SEQ ID NO: 127 - protein, 15 aa, Artificial Sequence
  chemically synthesized
HNYCWAPMQNNCMIE

SEQ ID NO: 128 - protein, 15 aa, Artificial Sequence
  chemically synthesized
HPPCMPMQNRCVSDH

SEQ ID NO: 129 - protein, 15 aa, Artificial Sequence
  chemically synthesized
HPVFCTHNPNCHHNY

SEQ ID NO: 130 - protein, 15 aa, Artificial Sequence
  chemically synthesized
HRGCMPMQNSCSTKN

SEQ ID NO: 131 - protein, 15 aa, Artificial Sequence
  chemically synthesized
HSSCWAPHTNRCHMG

SEQ ID NO: 132 - protein, 15 aa, Artificial Sequence
  chemically synthesized
HSTFCTHNRNCNNHS

SEQ ID NO: 133 - protein, 15 aa, Artificial Sequence
  chemically synthesized
HTCHYNTPMTNCHYS

SEQ ID NO: 134 - protein, 15 aa, Artificial Sequence
  chemically synthesized
HVSPSCTMMCNSYNF

SEQ ID NO: 135 - protein, 15 aa, Artificial Sequence
  chemically synthesized
IAAECTKHNMCNNAM

SEQ ID NO: 136 - protein, 15 aa, Artificial Sequence
  chemically synthesized
ICDSSAAPMTNRCMN

SEQ ID NO: 137 - protein, 15 aa, Artificial Sequence
  chemically synthesized
INVCMPMQNRCIGQN

SEQ ID NO: 138 - protein, 15 aa, Artificial Sequence
  chemically synthesized
IPCHGQWNFSNCKYQ

SEQ ID NO: 139 - protein, 15 aa, Artificial Sequence
  chemically synthesized
IPTCVPMQNHCYHSA

SEQ ID NO: 140 - protein, 15 aa, Artificial Sequence
  chemically synthesized
IVSKHCTSMCNPWNY

SEQ ID NO: 141 - protein, 15 aa, Artificial Sequence
  chemically synthesized
IYCPPMSNNIACQNN

SEQ ID NO: 142 - protein, 15 aa, Artificial Sequence
  chemically synthesized
KCALSNQPLMSNCLM

SEQ ID NO: 143 - protein, 15 aa, Artificial Sequence
  chemically synthesized
KCHDNNFCRNNMCNC

SEQ ID NO: 144 - protein, 15 aa, Artificial Sequence
  chemically synthesized
KCSLKHTLPMSNCMA

SEQ ID NO: 145 - protein, 15 aa, Artificial Sequence
  chemically synthesized
KCTNAFRMPMENCMS

SEQ ID NO: 146 - protein, 15 aa, Artificial Sequence
  chemically synthesized
KFCQQPQTPMQNCSS

SEQ ID NO: 147 - protein, 15 aa, Artificial Sequence
  chemically synthesized
KGCYTWTTMMNCIPK

SEQ ID NO: 148 - protein, 15 aa, Artificial Sequence
  chemically synthesized
KHSPYCFSMCNLQIS

SEQ ID NO: 149 - protein, 15 aa, Artificial Sequence
  chemically synthesized
KPRCSPMQNMCYNKQ

SEQ ID NO: 150 - protein, 15 aa, Artificial Sequence
  chemically synthesized
KTPCWTSMMNGCNHY

SEQ ID NO: 151 - protein, 15 aa, Artificial Sequence
  chemically synthesized
KYCPLMSNKPPCKPK

SEQ ID NO: 152 - protein, 15 aa, Artificial Sequence
  chemically synthesized
KYSPMCFAHCNSQIK

SEQ ID NO: 153 - protein, 15 aa, Artificial Sequence
  chemically synthesized
LCELSASTWSELCRR

SEQ ID NO: 154 - protein, 15 aa, Artificial Sequence
  chemically synthesized
LCGVYEMPMTNACAA

SEQ ID NO: 155 - protein, 15 aa, Artificial Sequence
  chemically synthesized
LDTFCTHNFNCSKHN

SEQ ID NO: 156 - protein, 15 aa, Artificial Sequence
  chemically synthesized
LEKNCTYNNMCNGYH

SEQ ID NO: 157 - protein, 15 aa, Artificial Sequence
  chemically synthesized
LESFCTHSPACVKHR

SEQ ID NO: 158 - protein, 15 aa, Artificial Sequence
  chemically synthesized
LGTCLPMQNGCTGSR

SEQ ID NO: 159 - protein, 15 aa, Artificial Sequence
  chemically synthesized
LHDCRSPAWDCFSLG

SEQ ID NO: 160 - protein, 15 aa, Artificial Sequence
  chemically synthesized
LHGFCTHNYSCSLEK

SEQ ID NO: 161 - protein, 15 aa, Artificial Sequence
  chemically synthesized
LKCLAEQISLDCRST

SEQ ID NO: 162 - protein, 15 aa, Artificial Sequence
  chemically synthesized
LKCQQPYTLMQNCAI

SEQ ID NO: 163 - protein, 15 aa, Artificial Sequence
  chemically synthesized
LMCTQLPMLNGPCHT

SEQ ID NO: 164 - protein, 15 aa, Artificial Sequence
  chemically synthesized
LQRFCTHNMLCQHNS

SEQ ID NO: 165 - protein, 15 aa, Artificial Sequence
  chemically synthesized
LRSPYCMGMCNFMTY

SEQ ID NO: 166 - protein, 15 aa, Artificial Sequence
  chemically synthesized
LSSFCTSNPFCNPYH

SEQ ID NO: 167 - protein, 15 aa, Artificial Sequence
  chemically synthesized
LTSPACRIMCNMDMS

SEQ ID NO: 168 - protein, 15 aa, Artificial Sequence
  chemically synthesized
LYNFCTHNNQCNNTF

SEQ ID NO: 169 - protein, 15 aa, Artificial Sequence
  chemically synthesized
MHDCRMPMTNSCTYP

SEQ ID NO: 170 - protein, 15 aa, Artificial Sequence
  chemically synthesized
MKSPACKSMCNLYIN

SEQ ID NO: 171 - protein, 15 aa, Artificial Sequence
  chemically synthesized
MKYFCTHNYNCNNNH

SEQ ID NO: 172 - protein, 15 aa, Artificial Sequence
  chemically synthesized
MPCHLMPMHNKCQST

SEQ ID NO: 173 - protein, 15 aa, Artificial Sequence
  chemically synthesized
MPGCMPMQNGCKHYN

SEQ ID NO: 174 - protein, 15 aa, Artificial Sequence
  chemically synthesized
MTEFCTHNRNCMMIS

SEQ ID NO: 175 - protein, 15 aa, Artificial Sequence
  chemically synthesized
MTICAPMQNYCPNAN

SEQ ID NO: 176 - protein, 15 aa, Artificial Sequence
  chemically synthesized
MYAPTCQQMCNPVSK

SEQ ID NO: 177 - protein, 15 aa, Artificial Sequence
  chemically synthesized
MYCWTAMMNKPCRFN

SEQ ID NO: 178 - protein, 15 aa, Artificial Sequence
  chemically synthesized
MYSSYCQLMCNPVPK

SEQ ID NO: 179 - protein, 15 aa, Artificial Sequence
  chemically synthesized
NCTMDQILPMSNCNM

SEQ ID NO: 180 - protein, 15 aa, Artificial Sequence
  chemically synthesized
NCVNIHYTMMSNCNF

SEQ ID NO: 181 - protein, 15 aa, Artificial Sequence
  chemically synthesized
NDYCLPMQNKCNMLS

SEQ ID NO: 182 - protein, 15 aa, Artificial Sequence
  chemically synthesized
NFCSIPMSNHPTCNN

SEQ ID NO: 183 - protein, 15 aa, Artificial Sequence
  chemically synthesized
NFNCWYNPNSDCNYY

SEQ ID NO: 184 - protein, 15 aa, Artificial Sequence
  chemically synthesized
NPACMPMQNSCSHYD

SEQ ID NO: 185 - protein, 15 aa, Artificial Sequence
  chemically synthesized
NRPCWTDMMNACNHG

SEQ ID NO: 186 - protein, 15 aa, Artificial Sequence
  chemically synthesized
NSNFCTANYNCNWIN

SEQ ID NO: 187 - protein, 15 aa, Artificial Sequence
  chemically synthesized
PCHTGTYMPMMNCHT

SEQ ID NO: 188 - protein, 15 aa, Artificial Sequence
  chemically synthesized
PECPPMSNNPHCNKL

SEQ ID NO: 189 - protein, 15 aa, Artificial Sequence
  chemically synthesized
PMCWEFYMMNKCIPY

SEQ ID NO: 190 - protein, 15 aa, Artificial Sequence
  chemically synthesized
PSCPPMSNQPACNRT

SEQ ID NO: 191 - protein, 15 aa, Artificial Sequence
  chemically synthesized
PSRCFVPMQNYCHNY

SEQ ID NO: 192 - protein, 15 aa, Artificial Sequence
  chemically synthesized
PTCREHFAMHNRCHD

SEQ ID NO: 193 - protein, 15 aa, Artificial Sequence
  chemically synthesized
PTHCAPMQNACTPHI

SEQ ID NO: 194 - protein, 15 aa, Artificial Sequence
  chemically synthesized
PTNCLPMQNRCKMNH

SEQ ID NO: 195 - protein, 15 aa, Artificial Sequence
  chemically synthesized
QASFCTHNYNCRTNN

SEQ ID NO: 196 - protein, 15 aa, Artificial Sequence
  chemically synthesized
QCGFLPTDKFSNCKN

SEQ ID NO: 197 - protein, 15 aa, Artificial Sequence
  chemically synthesized
QNHCWTTMINGCSWT

SEQ ID NO: 198 - protein, 15 aa, Artificial Sequence
  chemically synthesized
QQSFCTHSPACIASY

SEQ ID NO: 199 - protein, 15 aa, Artificial Sequence
  chemically synthesized
QSICWTYMTNGCMNY

SEQ ID NO: 200 - protein, 15 aa, Artificial Sequence
  chemically synthesized
QSQCAPMQNSCAQKH

SEQ ID NO: 201 - protein, 15 aa, Artificial Sequence
  chemically synthesized
QSYCYYWTMHCNDRY

SEQ ID NO: 202 - protein, 15 aa, Artificial Sequence
  chemically synthesized
QWYCSPMQNGCSNDN

SEQ ID NO: 203 - protein, 15 aa, Artificial Sequence
  chemically synthesized
QYCAVMSNNPYCRIN

SEQ ID NO: 204 - protein, 15 aa, Artificial Sequence
  chemically synthesized
QYSPYCYSMCNGHKN

SEQ ID NO: 205 - protein, 15 aa, Artificial Sequence
  chemically synthesized
RANCSQLGWSHCNIP

SEQ ID NO: 206 - protein, 15 aa, Artificial Sequence
  chemically synthesized
RCGNTYYTQMANCNN

SEQ ID NO: 207 - protein, 15 aa, Artificial Sequence
  chemically synthesized
RCPAYQHMAHVNCAN

SEQ ID NO: 208 - protein, 15 aa, Artificial Sequence
  chemically synthesized
RCSNLVNTPMQNCNM

SEQ ID NO: 209 - protein, 15 aa, Artificial Sequence
  chemically synthesized
REPCNVPMTNSCMRN

SEQ ID NO: 210 - protein, 15 aa, Artificial Sequence
  chemically synthesized
RGPCAVPMTNHCYSL

SEQ ID NO: 211 - protein, 15 aa, Artificial Sequence
  chemically synthesized
RISPGCTLMCNHYMY

SEQ ID NO: 212 - protein, 15 aa, Artificial Sequence
  chemically synthesized
RLCPPMSNKTACNNR

SEQ ID NO: 213 - protein, 15 aa, Artificial Sequence
  chemically synthesized
RMSCMPMQNSCHNTT

SEQ ID NO: 214 - protein, 15 aa, Artificial Sequence
  chemically synthesized
RNICLPMQNYCNNNN

SEQ ID NO: 215 - protein, 15 aa, Artificial Sequence
  chemically synthesized
RPCVPMQNDPTCTHI

SEQ ID NO: 216 - protein, 15 aa, Artificial Sequence
  chemically synthesized
RPMPCTSPGCTIGVH

SEQ ID NO: 217 - protein, 15 aa, Artificial Sequence
  chemically synthesized
RPSFCTHNKNCNHNR

SEQ ID NO: 218 - protein, 15 aa, Artificial Sequence
  chemically synthesized
RSTFCTHNPYCTQKL

SEQ ID NO: 219 - protein, 15 aa, Artificial Sequence
  chemically synthesized
RTATCSSFGTCSSLW

SEQ ID NO: 220 - protein, 15 aa, Artificial Sequence
  chemically synthesized
RTCQLMQNHPDCTMK

SEQ ID NO: 221 - protein, 15 aa, Artificial Sequence
  chemically synthesized
RTHCMPMQNHCMDSK

SEQ ID NO: 222 - protein, 15 aa, Artificial Sequence
  chemically synthesized
RTWVGCENHCYMLEK

SEQ ID NO: 223 - protein, 15 aa, Artificial Sequence
  chemically synthesized
RYGCVPMQNACGGPW

SEQ ID NO: 224 - protein, 15 aa, Artificial Sequence
  chemically synthesized
SAQCAPMQNSCHSIK

SEQ ID NO: 225 - protein, 15 aa, Artificial Sequence
  chemically synthesized
SCLNAHYQPMSNCNG

SEQ ID NO: 226 - protein, 15 aa, Artificial Sequence
  chemically synthesized
SCTPVDDNYFNGCSK

SEQ ID NO: 227 - protein, 15 aa, Artificial Sequence
  chemically synthesized
SDYCFPMQNQCAMWS

SEQ ID NO: 228 - protein, 15 aa, Artificial Sequence
  chemically synthesized
SFSEKCQNMCNPFNQ

SEQ ID NO: 229 - protein, 15 aa, Artificial Sequence
  chemically synthesized
SGCLPMSNNPVCNNR

SEQ ID NO: 230 - protein, 15 aa, Artificial Sequence
  chemically synthesized
SIGCLLPMTNGCNYK

SEQ ID NO: 231 - protein, 15 aa, Artificial Sequence
  chemically synthesized
SMCLPMQNNPYCNHK

SEQ ID NO: 232 - protein, 15 aa, Artificial Sequence
  chemically synthesized
SMFCFWHPDVCHDQE

SEQ ID NO: 233 - protein, 15 aa, Artificial Sequence
  chemically synthesized
SMHCSPMQNFCSNNF

SEQ ID NO: 234 - protein, 15 aa, Artificial Sequence
  chemically synthesized
SPPCDNMRNWCHPNM

SEQ ID NO: 235 - protein, 15 aa, Artificial Sequence
  chemically synthesized
SRECWAMMQNCSRNM

SEQ ID NO: 236 - protein, 15 aa, Artificial Sequence
  chemically synthesized
SRVCLPMQNYCKMNH

SEQ ID NO: 237 - protein, 15 aa, Artificial Sequence
  chemically synthesized
SSFCSPMQNFCATSI

SEQ ID NO: 238 - protein, 15 aa, Artificial Sequence
  chemically synthesized
SSLCMPMQNYCMNHK

SEQ ID NO: 239 - protein, 15 aa, Artificial Sequence
  chemically synthesized
STNACNMRNYCMWHQ

SEQ ID NO: 240 - protein, 15 aa, Artificial Sequence
  chemically synthesized
STNCIMPMTNGCRLN

SEQ ID NO: 241 - protein, 15 aa, Artificial Sequence
  chemically synthesized
STRCNFQAQMHCNYM

SEQ ID NO: 242 - protein, 15 aa, Artificial Sequence
  chemically synthesized
STSPACNHMCNPWNG

SEQ ID NO: 243 - protein, 15 aa, Artificial Sequence
  chemically synthesized
SVCSRSSPGGVLCRE

SEQ ID NO: 244 - protein, 15 aa, Artificial Sequence
  chemically synthesized
SVSPVCMSLCNRYHH

SEQ ID NO: 245 - protein, 15 aa, Artificial Sequence
  chemically synthesized
SWTCVPMQNACMHRT

SEQ ID NO: 246 - protein, 15 aa, Artificial Sequence
  chemically synthesized
SYCLPMTNKPMCNMY

SEQ ID NO: 247 - protein, 15 aa, Artificial Sequence
  chemically synthesized
SYCPHMAMAESCNEW

SEQ ID NO: 248 - protein, 15 aa, Artificial Sequence
  chemically synthesized
SYSSSCTQMCNHSYY

SEQ ID NO: 249 - protein, 15 aa, Artificial Sequence
  chemically synthesized
TAMPCTSPGCAMEPN

SEQ ID NO: 250 - protein, 15 aa, Artificial Sequence
  chemically synthesized
TAMRNCFDFCNNMTN

SEQ ID NO: 251 - protein, 15 aa, Artificial Sequence
  chemically synthesized
TASRSCFTMCNLYNH

SEQ ID NO: 252 - protein, 15 aa, Artificial Sequence
  chemically synthesized
TCHFPMYYQFANCIP

SEQ ID NO: 253 - protein, 15 aa, Artificial Sequence
  chemically synthesized
TCHSNYGPMQNSCYM

SEQ ID NO: 254 - protein, 15 aa, Artificial Sequence
  chemically synthesized
TCMHPNTGFYENCTI

SEQ ID NO: 255 - protein, 14 aa, Artificial Sequence
  chemically synthesized
TCSIDNYTSSKNCM

SEQ ID NO: 256 - protein, 15 aa, Artificial Sequence
  chemically synthesized
TDNCYGSRWIKCPQT

SEQ ID NO: 257 - protein, 15 aa, Artificial Sequence
  chemically synthesized
TEACSPMQNKCTHIY

SEQ ID NO: 258 - protein, 15 aa, Artificial Sequence
  chemically synthesized
TFDCVPMQNWCWSNN

SEQ ID NO: 259 - protein, 15 aa, Artificial Sequence
  chemically synthesized
TGRCQSPMTNGCHYK

SEQ ID NO: 260 - protein, 15 aa, Artificial Sequence
  chemically synthesized
THCSPMQNHPSCLHQ

SEQ ID NO: 261 - protein, 15 aa, Artificial Sequence
  chemically synthesized
TMQCMPMQNKCNYAN

SEQ ID NO: 262 - protein, 15 aa, Artificial Sequence
  chemically synthesized
TNPCIMPMVNHCHPL

SEQ ID NO: 263 - protein, 15 aa, Artificial Sequence
  chemically synthesized
TPWCAPMQNACPKGQ

SEQ ID NO: 264 - protein, 15 aa, Artificial Sequence
  chemically synthesized
TQMFCTHNPECQINL

SEQ ID NO: 265 - protein, 15 aa, Artificial Sequence
  chemically synthesized
TRCLPMSNHPRCAMP

SEQ ID NO: 266 - protein, 15 aa, Artificial Sequence
  chemically synthesized
TRFCAPMQNHCMGHN

SEQ ID NO: 267 - protein, 15 aa, Artificial Sequence
  chemically synthesized
TRKPCHSPGQCIAMY

SEQ ID NO: 268 - protein, 15 aa, Artificial Sequence
  chemically synthesized
TTCPMWAPMTNCTKS

SEQ ID NO: 269 - protein, 15 aa, Artificial Sequence
  chemically synthesized
TTHCSPMQNGCTINR

SEQ ID NO: 270 - protein, 15 aa, Artificial Sequence
  chemically synthesized
TWSPYCLSMCNLRYP

SEQ ID NO: 271 - protein, 15 aa, Artificial Sequence
  chemically synthesized
VAFCLEPMTNKCAQV

SEQ ID NO: 272 - protein, 15 aa, Artificial Sequence
  chemically synthesized
VATWCTVGPACAIKG

SEQ ID NO: 273 - protein, 15 aa, Artificial Sequence
  chemically synthesized
VCSNTQNFPMMNCNY

SEQ ID NO: 274 - protein, 15 aa, Artificial Sequence
  chemically synthesized
VGGCYVDDLGCMRMY

SEQ ID NO: 275 - protein, 15 aa, Artificial Sequence
  chemically synthesized
VHLCAPMQNGCMNTQ

SEQ ID NO: 276 - protein, 15 aa, Artificial Sequence
  chemically synthesized
VKSPFCFSTCNMRMN

SEQ ID NO: 277 - protein, 15 aa, Artificial Sequence
  chemically synthesized
VSCSHGSPDGLMCRG

SEQ ID NO: 278 - protein, 15 aa, Artificial Sequence
  chemically synthesized
VSRECTHLNHCNRLS

SEQ ID NO: 279 - protein, 15 aa, Artificial Sequence
  chemically synthesized
VTCPLMSNRPACNYH

SEQ ID NO: 280 - protein, 15 aa, Artificial Sequence
  chemically synthesized
VTSPACQNMCNTYNN

SEQ ID NO: 281 - protein, 15 aa, Artificial Sequence
  chemically synthesized
VVGCGFWDFGCQRHF

SEQ ID NO: 282 - protein, 15 aa, Artificial Sequence
  chemically synthesized
VVSPSCFSFCNTHWV

SEQ ID NO: 283 - protein, 15 aa, Artificial Sequence
  chemically synthesized
VWCPRMSNNPHCASM

SEQ ID NO: 284 - protein, 15 aa, Artificial Sequence
  chemically synthesized
VYSPLCKSFCNPIYY

SEQ ID NO: 285 - protein, 15 aa, Artificial Sequence
  chemically synthesized
WGKCSPMQNKCTNNS

SEQ ID NO: 286 - protein, 15 aa, Artificial Sequence
  chemically synthesized
WRGGCFSPGSCLGLL

SEQ ID NO: 287 - protein, 15 aa, Artificial Sequence
  chemically synthesized
WSQCQFPMVNQCMVR

SEQ ID NO: 288 - protein, 15 aa, Artificial Sequence
  chemically synthesized
WTSPNCMSMCNNWIR

SEQ ID NO: 289 - protein, 15 aa, Artificial Sequence
  chemically synthesized
WWGCVPMSNRCEGGR

SEQ ID NO: 290 - protein, 15 aa, Artificial Sequence
  chemically synthesized
YGNRCNMINSCMNNY

SEQ ID NO: 291 - protein, 15 aa, Artificial Sequence
  chemically synthesized
YKAFCTHNYNCISKN

SEQ ID NO: 292 - protein, 15 aa, Artificial Sequence
  chemically synthesized
YLFPTCIEFCNSSRQ

SEQ ID NO: 293 - protein, 15 aa, Artificial Sequence
  chemically synthesized
YQCPPMSNHPHCIVT

SEQ ID NO: 294 - protein, 15 aa, Artificial Sequence
  chemically synthesized
YQYCPPMSNRCAIKA

SEQ ID NO: 295 - protein, 15 aa, Artificial Sequence
  chemically synthesized
YSAYCNYSNMCNRNS

SEQ ID NO: 296 - skipped

SEQ ID NO: 297 - protein, 15 aa, Artificial Sequence
  chemically synthesized
QFCAWSYYLIGDCDI

SEQ ID NO: 298 - protein, 15 aa, Artificial Sequence
  chemically synthesized
QFCPASYYLIGDCDI

SEQ ID NO: 299 - protein, 15 aa, Artificial Sequence
  chemically synthesized
QFCPWAYYLIGDCDI

SEQ ID NO: 300 - protein, 15 aa, Artificial Sequence
  chemically synthesized
QFCPWSAYLIGDCDI

SEQ ID NO: 301 - protein, 15 aa, Artificial Sequence
  chemically synthesized
QFCPWSYALIGDCDI

SEQ ID NO: 302 - protein, 15 aa, Artificial Sequence
  chemically synthesized
QFCPWSYYAIGDCDI

SEQ ID NO: 303 - protein, 15 aa, Artificial Sequence
  chemically synthesized
QFCPWSYYLAGDCDI

SEQ ID NO: 304 - protein, 15 aa, Artificial Sequence
  chemically synthesized
QFCPWSYYLIGACDI

SEQ ID NO: 305 - protein, 15 aa, Artificial Sequence
  chemically synthesized
NLCAEHSFALDCRSY

SEQ ID NO: 306 - protein, 15 aa, Artificial Sequence
  chemically synthesized
NLCTAHSFALDCRSY

SEQ ID NO: 307 - protein, 15 aa, Artificial Sequence
  chemically synthesized
NLCTEASFALDCRSY

SEQ ID NO: 308 - protein, 15 aa, Artificial Sequence
  chemically synthesized
NLCTEHAFALDCRSY

SEQ ID NO: 309 - protein, 15 aa, Artificial Sequence
  chemically synthesized
NLCTEHSAALDCRSY

SEQ ID NO: 310 - protein, 15 aa, Artificial Sequence
  chemically synthesized
NLCTEHSFAADCRSY

SEQ ID NO: 311 - protein, 15 aa, Artificial Sequence
  chemically synthesized
NLCTEHSFALACRSY

SEQ ID NO: 312 - protein, 15 aa, Artificial Sequence
  chemically synthesized
NLCTEHSFALDCASY

SEQ ID NO: 313 - protein, 13 aa, Artificial Sequence
  chemically synthesized
CTEHSFALDCRSY

SEQ ID NO: 314 - protein, 10 aa, Artificial Sequence
  chemically synthesized
CTEHSFALDC

SEQ ID NO: 315 - protein, 255 aa, Artificial Sequence
  chemically synthesized
QGQSGQGCTEHSFALDCGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 316-322 - skipped (7 entries)

SEQ ID NO: 323 - protein, 213 aa, Artificial Sequence
  chemically synthesized
DIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - DNA, 639 bp, Artificial Sequence
  chemically synthesized
gacatccagatgacccagtccccatccagcctgtccgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctcccagcgtgttcatcttcccaccctccgacgagcagctgaagtccggcaccgccagcgtcgtgtgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccgcggcgagtgc

SEQ ID NO: 325 - protein, 448 aa, Artificial Sequence
  chemically synthesized
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLITVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - DNA, 1344 bp, Artificial Sequence
  chemically synthesized
caggtgcagctggtgcagtctggcgccgaagtgaagaaacctggcgcctccgtgaagatgtcctgcaaggcctccggctacaccttcaccagctactggatgcactgggtgcgacaggctccaggccagggcctcgaatggatcggcgccatctaccccggcaactccgagacaggctacgcccagaagttccagggcagagccaccctgaccgccgacacctccacctccaccgcctacatggaactgtccagcctgcggagcgaggacaccgccgtgtactactgcaccagagagaactgggaccccggcttcgccttctggggccagggcaccctgatcaccgtgtcctccgccagcaccaagggcccctccgtgttccctctggccccttccagcaagtccacctctggcggcacagctgccctgggctgcctggtgaaagactacttccccgagcccgtgaccgtgtcctggaactctggcgccctgaccagcggagtgcacaccttccctgccgtgctgcagtcctccggcctgtactccctgtcctccgtggtgacagtgccctcctccagcctgggcacccagacctacatctgcaacgtgaaccacaagccctccaacaccaaggtggacaagaaggtggaacccaagtcctgcgacaagacccacacctgtcctccctgccctgcccctgaactgctgggcggaccttccgtgtttctgttccccccaaagcccaaggacaccctgatgatctcccggacccccgaagtgacctgcgtggtggtggacgtgtcccacgaggaccctgaagtgaagttcaattggtacgtggacggcgtggaagtgcacaacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatctccaaggccaagggccagccccgcgagccccaggtgtacacactgccacctagccgggaagagatgaccaagaaccaggtgtccctgacctgtctggtgaaaggcttctacccctccgatatcgccgtggaatgggagagcaacggccagcccgagaacaactacaagaccaccccacctgtgctggactccgacggctcattcttcctgtactccaagctgaccgtggacaagtcccggtggcagcagggcaacgtgttctcctgcagcgtgatgcacgaggccctgcacaaccactacacccagaagtccctgtccctgagccccggcaag

SEQ ID NO: 327 - protein, 260 aa, Artificial Sequence
  chemically synthesized
QGQSGQGQFCPWSYYLIGDCDIGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - DNA, 780 bp, Artificial Sequence
  chemically synthesized
cagggccagtccggccagggacagttctgcccttggtcctactacctgatcggcgactgcgacatcggcggaggctcctccggcggctccatctcctctggcctgctgtccggcagatccgacaaccacggcggtggcagcgacatccagatgacccagtccccatccagcctgtccgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctcccagcgtgttcatcttcccaccctccgacgagcagctgaagtccggcaccgccagcgtcgtgtgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccgcggcgagtgc

SEQ ID NO: 329 - protein, 264 aa, Artificial Sequence
  chemically synthesized
QGQSGQGQFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - DNA, 792 bp, Artificial Sequence
  chemically synthesized
cagggccagtccggccagggacagttctgcccttggtcctactacctgatcggcgactgcgacatcggcggaggctcctctggcggctctgctgtgggcctgctggctccacctggcggcctgtccggcagatctgacaaccacggcggctccgacatccagatgacccagtccccctccagcctgtccgcctccgtgggcgacagagtgacaatcacctgttccgccagctcctccgtgtactacatgtactggttccagcagaagcccggaaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctccttccgtgttcatcttcccaccctccgacgagcagctgaagagcggcaccgccagcgtggtctgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 331 - protein, 260 aa, Artificial Sequence
  chemically synthesized
QGQSGQGNLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - DNA, 780 bp, Artificial Sequence
  chemically synthesized
cagggacagtctggccagggcaacctgtgcaccgagcactctgccgctctggactgcagatcctacggcggaggctcctccggcggctccatctcctctggcctgctgtccggcagatccgacaaccatggcggcggatccgacatccagatgacccagtccccctccagcctgtccgcctccgtgggcgacagagtgacaatcacctgttccgccagctcctccgtgtactacatgtactggttccagcagaagcccggcaaggcccccaagctgtggatctactccaccagcaacctggcctccggcgtgccctccagattctccggctctggctccggcaccgactacaccctgaccatctccagcatgcagcccgaggacttcgccacctactactgccagcagcggcggaactacccctacaccttcggacagggcaccaagctggaaatcaagcggaccgtggccgctcccagcgtgttcatcttcccaccctccgacgagcagctgaagtccggcaccgccagcgtggtctgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 333 - protein, 264 aa, Artificial Sequence
  chemically synthesized
QGQSGQGNLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - DNA, 792 bp, Artificial Sequence
  chemically synthesized
cagggccagtctggacagggcaacctgtgcaccgagcactctgccgctctggactgcagatcctacggcggaggctcctctggcggctctgctgtgggcctgctggctccacctggcggcctgtccggcagatctgacaaccacggcggctccgacatccagatgacccagtccccctccagcctgtctgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggacagggcaccaagctggaaatcaagcggaccgtggccgctccctccgtgttcatcttcccaccctccgacgagcagctgaagtccggcaccgccagcgtggtctgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 335 - protein, 255 aa, Artificial Sequence
  chemically synthesized
QGQSGQGCTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - DNA, 765 bp, Artificial Sequence
  chemically synthesized
cagggccagtctggccagggctgcaccgagcacagcttcgccctggactgtggcggcggatcctccggcggctccatctcctctggcctgctgtccggcagatccgacaaccacggcggaggctccgacatccagatgacccagtccccctccagcctgtccgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctccctccgtgttcatcttcccaccctccgacgagcagctgaagtccggcaccgccagcgtggtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 337 - protein, 259 aa, Artificial Sequence
  chemically synthesized
QGQSGQGCTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - DNA, 777 bp, Artificial Sequence
  chemically synthesized
cagggccagtctggccagggctgcaccgagcacagcttcgccctggactgtggcggcggatcttctggcggctctgctgtgggcctgctggctcctcctggcggcctgtccggcagatctgacaaccacggcggctccgacatccagatgacccagtccccctccagcctgtccgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctccctccgtgttcatcttcccaccctccgacgagcagctgaagtccggcaccgccagcgtggtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 339 - protein, 5 aa, Artificial Sequence
  chemically synthesized
GSGGS

SEQ ID NO: 340 - protein, 4 aa, Artificial Sequence
  chemically synthesized
GGGS

SEQ ID NO: 341 - protein, 4 aa, Artificial Sequence
  chemically synthesized
GGSG

SEQ ID NO: 342 - protein, 5 aa, Artificial Sequence
  chemically synthesized
GGSGG

SEQ ID NO: 343 - protein, 5 aa, Artificial Sequence
  chemically synthesized
GSGSG

SEQ ID NO: 344 - protein, 5 aa, Artificial Sequence
  chemically synthesized
GSGGG

SEQ ID NO: 345 - protein, 5 aa, Artificial Sequence
  chemically synthesized
GGGSG

SEQ ID NO: 346 - protein, 5 aa, Artificial Sequence
  chemically synthesized
GSSSG

SEQ ID NO: 347 - protein, 13 aa, Artificial Sequence
  chemically synthesized
GSSGGSGGSGGSG

SEQ ID NO: 348 - protein, 11 aa, Artificial Sequence
  chemically synthesized
GSSGGSGGSGG

SEQ ID NO: 349 - protein, 12 aa, Artificial Sequence
  chemically synthesized
GSSGGSGGSGGS

SEQ ID NO: 350 - protein, 16 aa, Artificial Sequence
  chemically synthesized
GSSGGSGGSGGSGGGS

SEQ ID NO: 351 - protein, 10 aa, Artificial Sequence
  chemically synthesized
GSSGGSGGSG

SEQ ID NO: 352 - protein, 11 aa, Artificial Sequence
  chemically synthesized
GSSGGSGGSGS

SEQ ID NO: 353 - protein, 4 aa, Artificial Sequence
  chemically synthesized
GGGS

SEQ ID NO: 354 - protein, 5 aa, Artificial Sequence
  chemically synthesized
GSSGT

SEQ ID NO: 355 - protein, 4 aa, Artificial Sequence
  chemically synthesized
GSSG

SEQ ID NO: 356 - protein, 8 aa, Artificial Sequence
  chemically synthesized
TGRGPSWV

SEQ ID NO: 357 - protein, 8 aa, Artificial Sequence
  chemically synthesized
SARGPSRW

SEQ ID NO: 358 - protein, 8 aa, Artificial Sequence
  chemically synthesized
TARGPSFK

SEQ ID NO: 359 - protein, 8 aa, Artificial Sequence
  chemically synthesized
LSGRSDNH

SEQ ID NO: 360 - protein, 8 aa, Artificial Sequence
  chemically synthesized
GGWHTGRN

SEQ ID NO: 361 - protein, 8 aa, Artificial Sequence
  chemically synthesized
HTGRSGAL

SEQ ID NO: 362 - protein, 8 aa, Artificial Sequence
  chemically synthesized
PLTGRSGG

SEQ ID NO: 363 - protein, 8 aa, Artificial Sequence
  chemically synthesized
AARGPAIH

SEQ ID NO: 364 - protein, 8 aa, Artificial Sequence
  chemically synthesized
RGPAFNPM

SEQ ID NO: 365 - protein, 8 aa, Artificial Sequence
  chemically synthesized
SSRGPAYL

SEQ ID NO: 366 - protein, 8 aa, Artificial Sequence
  chemically synthesized
RGPATPIM

SEQ ID NO: 367 - protein, 4 aa, Artificial Sequence
  chemically synthesized
RGPA

SEQ ID NO: 368 - protein, 10 aa, Artificial Sequence
  chemically synthesized
GGQPSGMWGW

SEQ ID NO: 369 - protein, 10 aa, Artificial Sequence
  chemically synthesized
FPRPLGITGL

SEQ ID NO: 370 - protein, 10 aa, Artificial Sequence
  chemically synthesized
VHMPLGFLGP

SEQ ID NO: 371 - protein, 8 aa, Artificial Sequence
  chemically synthesized
SPLTGRSG

SEQ ID NO: 372 - protein, 8 aa, Artificial Sequence
  chemically synthesized
SAGFSLPA

SEQ ID NO: 373 - protein, 9 aa, Artificial Sequence
  chemically synthesized
LAPLGLQRR

SEQ ID NO: 374 - protein, 8 aa, Artificial Sequence
  chemically synthesized
SGGPLGVR

SEQ ID NO: 375 - protein, 4 aa, Artificial Sequence
  chemically synthesized
PLGL

SEQ ID NO: 376 - protein, 7 aa, Artificial Sequence
  chemically synthesized
ISSGLSS

SEQ ID NO: 377 - protein, 8 aa, Artificial Sequence
  chemically synthesized
QNQALRMA

SEQ ID NO: 378 - protein, 8 aa, Artificial Sequence
  chemically synthesized
AQNLLGMV

SEQ ID NO: 379 - protein, 8 aa, Artificial Sequence
  chemically synthesized
STFPFGMF

SEQ ID NO: 380 - protein, 8 aa, Artificial Sequence
  chemically synthesized
PVGYTSSL

SEQ ID NO: 381 - protein, 8 aa, Artificial Sequence
  chemically synthesized
DWLYWPGI

SEQ ID NO: 382 - protein, 8 aa, Artificial Sequence
  chemically synthesized
ISSGLLSS

SEQ ID NO: 383 - protein, 8 aa, Artificial Sequence
  chemically synthesized
LKAAPRWA

SEQ ID NO: 384 - protein, 8 aa, Artificial Sequence
  chemically synthesized
GPSHLVLT

SEQ ID NO: 385 - protein, 8 aa, Artificial Sequence
  chemically synthesized
LPGGLSPW

SEQ ID NO: 386 - protein, 8 aa, Artificial Sequence
  chemically synthesized
MGLFSEAG

SEQ ID NO: 387 - protein, 8 aa, Artificial Sequence
  chemically synthesized
SPLPLRVP

SEQ ID NO: 388 - protein, 8 aa, Artificial Sequence
  chemically synthesized
RMHLRSLG

SEQ ID NO: 389 - protein, 8 aa, Artificial Sequence
  chemically synthesized
LAAPLGLL

SEQ ID NO: 390 - protein, 8 aa, Artificial Sequence
  chemically synthesized
AVGLLAPP

SEQ ID NO: 391 - protein, 8 aa, Artificial Sequence
  chemically synthesized
LLAPSHRA

SEQ ID NO: 392 - protein, 8 aa, Artificial Sequence
  chemically synthesized
PAGLWLDP

SEQ ID NO: 393 - protein, 7 aa, Artificial Sequence
  chemically synthesized
GPRSFGL

SEQ ID NO: 394 - protein, 6 aa, Artificial Sequence
  chemically synthesized
GPRSFG

SEQ ID NO: 395 - protein, 12 aa, Artificial Sequence
  chemically synthesized
NTLSGRSENHSG

SEQ ID NO: 396 - protein, 12 aa, Artificial Sequence
  chemically synthesized
NTLSGRSGNHGS

SEQ ID NO: 397 - protein, 12 aa, Artificial Sequence
  chemically synthesized
TSTSGRSANPRG

SEQ ID NO: 398 - protein, 8 aa, Artificial Sequence
  chemically synthesized
TSGRSANP

SEQ ID NO: 399 - protein, 8 aa, Artificial Sequence
  chemically synthesized
VAGRSMRP

SEQ ID NO: 400 - protein, 8 aa, Artificial Sequence
  chemically synthesized
VVPEGRRS

SEQ ID NO: 401 - protein, 8 aa, Artificial Sequence
  chemically synthesized
ILPRSPAF

SEQ ID NO: 402 - protein, 8 aa, Artificial Sequence
  chemically synthesized
MVLGRSLL

SEQ ID NO: 403 - protein, 8 aa, Artificial Sequence
  chemically synthesized
QGRAITFI

SEQ ID NO: 404 - protein, 8 aa, Artificial Sequence
  chemically synthesized
SPRSIMLA

SEQ ID NO: 405 - protein, 8 aa, Artificial Sequence
  chemically synthesized
SMLRSMPL

SEQ ID NO: 406 - protein, 13 aa, Artificial Sequence
  chemically synthesized
ISSGLLSGRSDNH

SEQ ID NO: 407 - protein, 22 aa, Artificial Sequence
  chemically synthesized
ISSGLLSSGGSGGSLSGRSDNH

SEQ ID NO: 408 - protein, 22 aa, Artificial Sequence
  chemically synthesized
AVGLLAPPGGTSTSGRSANPRG

SEQ ID NO: 409 - protein, 22 aa, Artificial Sequence
  chemically synthesized
TSTSGRSANPRGGGAVGLLAPP

SEQ ID NO: 410 - protein, 24 aa, Artificial Sequence
  chemically synthesized
VHMPLGFLGPGGTSTSGRSANPRG

SEQ ID NO: 411 - protein, 24 aa, Artificial Sequence
  chemically synthesized
TSTSGRSANPRGGGVHMPLGFLGP

SEQ ID NO: 412 - protein, 18 aa, Artificial Sequence
  chemically synthesized
AVGLLAPPGGLSGRSDNH

SEQ ID NO: 413 - protein, 18 aa, Artificial Sequence
  chemically synthesized
LSGRSDNHGGAVGLLAPP

SEQ ID NO: 414 - protein, 20 aa, Artificial Sequence
  chemically synthesized
VHMPLGFLGPGGLSGRSDNH

SEQ ID NO: 415 - protein, 20 aa, Artificial Sequence
  chemically synthesized
LSGRSDNHGGVHMPLGFLGP

SEQ ID NO: 416 - protein, 22 aa, Artificial Sequence
  chemically synthesized
LSGRSDNHGGSGGSISSGLLSS

SEQ ID NO: 417 - protein, 22 aa, Artificial Sequence
  chemically synthesized
LSGRSGNHGGSGGSISSGLLSS

SEQ ID NO: 418 - protein, 22 aa, Artificial Sequence
  chemically synthesized
ISSGLLSSGGSGGSLSGRSGNH

SEQ ID NO: 419 - protein, 22 aa, Artificial Sequence
  chemically synthesized
LSGRSDNHGGSGGSQNQALRMA

SEQ ID NO: 420 - protein, 22 aa, Artificial Sequence
  chemically synthesized
QNQALRMAGGSGGSLSGRSDNH

SEQ ID NO: 421 - protein, 22 aa, Artificial Sequence
  chemically synthesized
LSGRSGNHGGSGGSQNQALRMA

SEQ ID NO: 422 - protein, 22 aa, Artificial Sequence
  chemically synthesized
QNQALRMAGGSGGSLSGRSGNH

SEQ ID NO: 423 - protein, 13 aa, Artificial Sequence
  chemically synthesized
ISSGLLSGRSGNH

SEQ ID NO: 424 - protein, 6 aa, Artificial Sequence
  chemically synthesized
QGQSGQ

SEQ ID NO: 425 - protein, 120 aa, Artificial Sequence
  chemically synthesized
VTLKVCGPGILQPSQTLGLACTFSGISLSTSGMGLSWLRKPSGKALEWLASIWNNDNYYNPSLKSRLTISKETSNNQVFLKLTSVDTADSTTYFCAWRERTMVTTSMLWTTGVKEPQSPS

SEQ ID NO: 426 - protein, 108 aa, Artificial Sequence
  chemically synthesized
DILMTQSPASLSASVGENVTITCRASENIYSYLAWYQQKQGKSPQLLLYKEKTLAEGVSSRFSGSGSGTQFSLRINSLQPEDFGSYYCQHHYGIPWTFGGGTKLEIKR

SEQ ID NO: 427 - protein, 116 aa, Artificial Sequence
  chemically synthesized
EVQLVQSGAEVKKPGASVKVSCKASGYTFTSYWMHWVRQAPGQRLEWIGEINPTNGRTNYIEKFKSRATLTVDKSASTAYMELSSLRSEDTAVYYCARGTRAYHYWGQGTMVTVSS

SEQ ID NO: 428 - protein, 119 aa, Artificial Sequence
  chemically synthesized
EVQLVQSGAEVKKPGASVKVSCKGSGYTFTDYAMHWVRQAPGQGLEWMGGISTYFGRTNYNQKFKGRVTMTVDTSISTAYMELSRLRSDDTAVYYCARGLSGNYVMDYWGQGTTVTVSS

SEQ ID NO: 429 - protein, 120 aa, Artificial Sequence
  chemically synthesized
EVQLVQSGAEVKKPGASVKVSCKASGYTFTSYWMHWVRQAPGQGLEWIGNIYPGSGSTKYDERFKSRVTITVDTSTSTAYLELSSLRSEDTAVYYCTRGGYDSRAWFAYWGQGTLVTVSS

SEQ ID NO: 430 - protein, 122 aa, Artificial Sequence
  chemically synthesized
EVQLVESGPGLVKPSETLSLTCTVSGNSITSEYAWNWIRQPPGKGLEWIGYISYSGTTSYNPSLKSRVTISRDTSKNQLSLKLSSVTAADTAVYYCARYGYGNPATRYFDVWGQGTLVTVSS

SEQ ID NO: 431 - protein, 116 aa, Artificial Sequence
  chemically synthesized
EVQLVQSGAEVKKPGASVKVSCKASGYTFTSYWMHWVRQAPGQRLEWIGEIAPTNGRTNYIEKFKSRATLTVDKSASTAYMELSSLRSEDTAVYYCARGTRAYHYWGQGTMVTVSS

SEQ ID NO: 432 - protein, 116 aa, Artificial Sequence
  chemically synthesized
EVQLVQSGAEVKKPGASVKVSCKASGYTFTSYWMHWVRQAPGQRLEWIGEINPANGRTNYIEKFKSRATLTVDKSASTAYMELSSLRSEDTAVYYCARGTRAYHYWGQGTMVTVSS

SEQ ID NO: 433 - protein, 107 aa, Artificial Sequence
  chemically synthesized
DIQMTQSPSSLSASVGDRVTITCRASDNLYSNLAWYQQKPGKSPKLLVYDATNLADGVPSRFSGSGSGTDYTLTISSLQPEDFATYYCQHFWGTPLTFGQGTKVEIK

SEQ ID NO: 434 - protein, 111 aa, Artificial Sequence
  chemically synthesized
DIVMTQSPDSLAVSLGERATINCRASESVDSYGNSFMHWYQQKPGQPPKLLIYRASNLESGVPDRFSGSGSRTDFTLTISSLQAEDVAVYYCQQSNEAPPTFGQGTKLEIK

SEQ ID NO: 435 - protein, 111 aa, Artificial Sequence
  chemically synthesized
DIVMTQSPDSLAVSLGERATINCRARQSVSTSSYSFMHWYQQPAGQPPKLLIKYASIQESGVPDRFSGSGSGTDFTLTISSLQAEDVAVYYCQHTWEIPFTFGQGTKVEIK

SEQ ID NO: 436 - protein, 107 aa, Artificial Sequence
  chemically synthesized
DIQMTQSPSSLSASVGDRVTITCRASKSISKYLAWYQQKPGKTNKLLLYSGSTLQSGVPSRFSGSGSGTDYTLTISSLQPEDFATYYCQQHNEYPWTFGQGTKVEIK

SEQ ID NO: 437 - protein, 107 aa, Artificial Sequence
  chemically synthesized
DIQMTQSPSSLSASVGDRVTITCRASDNLYSNLAWYQQKPGKSPKLLVYDATNLADGVPSRFSGSGSGTDYTLTISSLQPEDFATYYCQHFAGTPLTFGQGTKVEIK

SEQ ID NO: 438 - protein, 118 aa, Artificial Sequence
  chemically synthesized
EVQLVESGGGLVQPGGSLRLSCAASGFTFSNYGMHWIRQAPGKGLEWIAMIYYDSSKMNYADTVKGRFTISRDNAKNSLYLQMNSLRAEDTAVYYCAVPTSHYVVDVWGQGTTVTVSS

SEQ ID NO: 439 - protein, 7 aa, Artificial Sequence
  chemically synthesized
TSGVGVG

SEQ ID NO: 440 - protein, 118 aa, Artificial Sequence
  chemically synthesized
QVQLVQSGAEVKKPGASVKVSCKASGFTFSNYGMHWIRQAPGQGLEWIAMIYYDSSKMNYADTVKGRFTITRDNSTNTLYMELSSLRSEDTAVYYCAVPTSHYVVDVWGQGTTVTVSS

SEQ ID NO: 441 - protein, 16 aa, Artificial Sequence
  chemically synthesized
LIYWDDDKHYSPSLKS

SEQ ID NO: 442 - protein, 118 aa, Artificial Sequence
  chemically synthesized
EVQLVESGGGLVQPGNSLTLSCVASGFTFSNYGMHWIRQAPKKGLEWIAMIYYDSSKMNYADTVKGRFTISRDNSKNTLYLEMNSLRSEDTAMYYCAVPTSHYVVDVWGQGVSVTVSS

SEQ ID NO: 443 - protein, 113 aa, Artificial Sequence
  chemically synthesized
QVQLVQSGAEVKKPGSSVKVSCKASGYTFTNYDIHWVRQAPGQGLEWMGWIYPGDGSTKYNEKFKGRVTITADESTSTAYMELSSLRSEDTAVYYCAREWAYWGQGTTVTVSS

SEQ ID NO: 444 - protein, 138 aa, Artificial Sequence
  chemically synthesized
MEWSWIFLFLLSGTAGVLSEVELQQFGIEMVKPGASVKISCKASGYIFTDYHMDWVRQSHGKSLEWIGDIDPKYDRVTYNQKFKGKASLTADKSSSTAYMELRSLTSEDTAVYYCAKTGAYGDYLAYWGQGTLVTVSA

SEQ ID NO: 445 - protein, 138 aa, Artificial Sequence
  chemically synthesized
MGWSYIILFLVATATGVHSQVQLQQPGAELVKPGTSVKLSCKASGYNFTSYWINWVKLRPGQGLEWIGDIYPGSGSTNYNEKFKSKATLTVDTSSSTAYMQLSSLASEDSALYYCARSAYRYDWFAYWGQGTLVTVSA

SEQ ID NO: 446 - protein, 136 aa, Artificial Sequence
  chemically synthesized
MLLGLKWVFFVVFYQGVHCEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVAYGSRNYWGQGTTLTVSS

SEQ ID NO: 447 - protein, 138 aa, Artificial Sequence
  chemically synthesized
MGWSWIFLFLLSGTAGVHSEVQLQQSGPEVVKPGASMKMSCKTSGYKFTGYYMDWVKQSLGASFEWIGRVIPSNGDTRYNQKFEGKATLTVDRSSSTAYMELNSLTSEDSAVYYCARKPLSGNAADYWGQGTSVTVST

SEQ ID NO: 448 - protein, 449 aa, Artificial Sequence
  chemically synthesized
EVQLQQSGPEVVKPGASMKMSCKTSGYKFTGYYMDWVKQSLGASFEWIGRVIPSNGDTRYNQKFEGKATLTVDRSSSTAYMELNSLTSEDSAVYYCARKPLSGNAADYWGQGTSVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 449 - protein, 132 aa, Artificial Sequence
  chemically synthesized
MKLPVRLLVLMFWIPASSSDLVMTQTPLSLPVSLGDQASISCRSSQSLVHSDGNTYFYWYLQKPGQSPKLLIYKVSNRFSGVPDRFSAGGSGTYFTLKISRVEAEDLGVYFCSQTTHFPPTFGGGTKLEIKR

SEQ ID NO: 450 - protein, 128 aa, Artificial Sequence
  chemically synthesized
MSVPTQVLGLLLLWLTDARCDIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTKLEIKR

SEQ ID NO: 451 - protein, 134 aa, Artificial Sequence
  chemically synthesized
MESQTQVLMSLLFWVSGTCGDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPYTFGGGTKLEIKR

SEQ ID NO: 452 - protein, 130 aa, Artificial Sequence
  chemically synthesized
MTMLSLAPLLSLLLLCVSDSRAETTVTQSPASLSVATGEKVTIRCITSTDIDDDMNWYQQKPGEPPKLLISDGNTLRPGVPSRFSSSGYGTDFVFTIENTLSEDITDYYCMQSDNMPFTFGSGTKLEIKR

SEQ ID NO: 453 - protein, 214 aa, Artificial Sequence
  chemically synthesized
ETTVTQSPASLSVATGEKVTIRCITSTDIDDDMNWYQQKPGEPPKLLISDGNTLRPGVPSRFSSSGYGTDFVFTIENTLSEDITDYYCMQSDNMPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 454 - protein, 137 aa, Artificial Sequence
  chemically synthesized
MEWSWVMLFLLSGTAGVRSEVQLQQSGPELVKPGASMKISCKASGYSFTGYTMNWVKQSHGENLEWIGRINPHNGGTDYNQKFKDKAPLTVDKSSNTAYMELLSLTSEDSAVYYCARGYYYYSLDYWGQGTSVTVSS

SEQ ID NO: 455 - protein, 128 aa, Artificial Sequence
  chemically synthesized
MDFQVQIFSFLLISASVILSRGQIVLTQSPAIMSASPGEKVTMTCSASSSIDYIHWYQQKSGTSPKRWIYDTSKLASGVPARFSGSGSGTSYSLTISSMEPEDAATYYCHQRNSYPWTFGGGTRLEIR

SEQ ID NO: 456 - protein, 121 aa, Artificial Sequence
  chemically synthesized
MAQVQLLESGGGLVQPGGSLRLSCAASGFIFNTEYMAWVRQAPGKGLEWVSAIKEQSGSTYYADSVKGRFTISRDNSKNTLYLQMNSLRAEDTAVYYCAAQMHHEAEVKFWGQGTLVTVSS

SEQ ID NO: 457 - protein, 127 aa, Artificial Sequence
  chemically synthesized
MAQVQLLESGGGLVQPGGSLRLSCAASGFKFSAEYMSWVRQAPGKGLEWVSTIKMNNGSTYYADSVKGRFTISRDNSKHTLYLQMNSLRAEDTAVYYCARPMAWRGNVVRAENLRFWGQGTLVTVSS

SEQ ID NO: 458 - protein, 138 aa, Artificial Sequence
  chemically synthesized
MEFGLSWLFLVAILKGVQCEVQLQQSGTVLARPGASVKMSCKASGYSFTIYWIHWVKQRPGQGLEWIATIYPGNSDIIYNQKFKGKAKLTAVTSASTAYMELSSLTNEASAVYYCTRQGYDYYAMDYWGQGTSVTVSS

SEQ ID NO: 459 - protein, 129 aa, Artificial Sequence
  chemically synthesized
MDMRVPAQLLGLLLLWLPGARCDVQITQSPSYLAASPGETIIINCRASKSISKYLAWYQEKPGKTNKLLIYSGSTLQSGIPSRFSGSGSGTDFTLTISSLEPQDFAMYYCQQHNEYPWTFGGGTKLEIK

SEQ ID NO: 460 - protein, 108 aa, Artificial Sequence
  chemically synthesized
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIKR

SEQ ID NO: 461 - protein, 130 aa, Artificial Sequence
  chemically synthesized
MDMRVPAQLLGLLLLWLPGARCDVQITQSPSYLAASPGETIIINCRASKSISKYLAWYQEKPGKTNKLLIYSGSTLQSGIPSRFSGSGSGTDFTLTISSLEPQDFAMYYCQQHNEYPWTFGGGTKLEIKR

SEQ ID NO: 462 - protein, 129 aa, Artificial Sequence
  chemically synthesized
MDMRVPAQLLGLLLLWLPGARCDVQITQSPSYLAASPGETIIINCRASKSISKYLAWYQEKPGKTNKLLIYSGSTLQSGIPSRFSGSGSGTDFTLTISSLEPQDFAMYYCQQHNEYPWTFGGGTKLQIK

SEQ ID NO: 463 - protein, 108 aa, Artificial Sequence
  chemically synthesized
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLQIKR

SEQ ID NO: 464 - protein, 130 aa, Artificial Sequence
  chemically synthesized
MDMRVPAQLLGLLLLWLPGARCDVQITQSPSYLAASPGETIIINCRASKSISKYLAWYQEKPGKTNKLLIYSGSTLQSGIPSRFSGSGSGTDFTLTISSLEPQDFAMYYCQQHNEYPWTFGGGTKLQIKR

SEQ ID NO: 465 - protein, 119 aa, Artificial Sequence
  chemically synthesized
QVQLQESGGGLVQPGGSLRLSCAASGFSFNTYTMHWVRQAPGKGLEWVADIAYDGSTKYYADSVKGRFTISRDNAKNSLYLQMNSLRAEDTAVYYCARDAVAGEGYFDLWGRGTLVTVS

SEQ ID NO: 466 - protein, 118 aa, Artificial Sequence
  chemically synthesized
QVQLQQSGGGVVQPGGSLRLSCAASEFTFSASGMHWVRQAPGKGLEWMAFIAYDGNQKFYADSVKGRFTISRDNSKNTLYLQMDSLRGEDTAVYYCAKEMQREGYFDYWGQGTLVTVS

SEQ ID NO: 467 - protein, 118 aa, Artificial Sequence
  chemically synthesized
QVQLAESGGGLVKPGGSLRLSCAASGFTFSDYYMSWIRQAPGKGLEWVSYISTSGSSIYYVDSVKGRFTISRDNAKNSLYLQMDSLRDDDTAVYYCARDLHGDYAFDSWGQGTLVTVS

SEQ ID NO: 468 - protein, 118 aa, Artificial Sequence
  chemically synthesized
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKVSSSWSHFDYWGQGTLVTVS

SEQ ID NO: 469 - protein, 117 aa, Artificial Sequence
  chemically synthesized
QVQLVESGGGLVEPGGSLRLSCAASGFTFSNYAINWVRQAPGKGLEWVANIHHDGNGKYYVDSVEGRFTISRDNAKNSLYLQMDSLRAEDTAIYYCARDGYGGYLDLWGQGTLVTVS

SEQ ID NO: 470 - protein, 119 aa, Artificial Sequence
  chemically synthesized
QVQLQESGGGVVQPGRSLRLSCAASRFTFSSYAMHWVRQAPGKGLEWVAVISYDGSNKYYADSVKGRFTISRDNSKNTLYLQMNSLRAEDTAVYYCARDLSGYGDYPDYWGQGTLVTVS

SEQ ID NO: 471 - protein, 110 aa, Artificial Sequence
  chemically synthesized
SNFMLTQDPAVSVALGQTVRITCQGDSLRSYYASWYQQKPGQAPVLVIYGKNNRPSGIPDRFSGSKSGNSASLDISGLQSEDEADYYCATWDDNLSGPIFGGGTKVTVLG

SEQ ID NO: 472 - protein, 111 aa, Artificial Sequence
  chemically synthesized
SQSALTQDPAVSVALGQTVRITCQGDSLRSYYASWYQQLPGTAPKLLIYRNNQRPSGVPDRFSGSKSGTSASLAISGLRSEDEADYYCAAWDDSLSAWVFGGGTKLTVLGA

SEQ ID NO: 473 - protein, 109 aa, Artificial Sequence
  chemically synthesized
SSELTQDPAVSVALGQTVRITCQGDSLRSYYASWYQQKPGQAPVLVIYGKNNRPSGIPDRFSGSKSGNSASLDISGLQSEDEADYYCATWDDNLSGPIFGGGTKVTVLG

SEQ ID NO: 474 - protein, 110 aa, Artificial Sequence
  chemically synthesized
SDVVMTQSPSTLSASVGDRVTITCRASQYISNWLAWYQQKPGKAPKLLIYKASSLESGVPSRFSGSGSGTEFTLTISSLQPEDFATYYCQESYNTPLFTFGPGTKLEIKR

SEQ ID NO: 475 - protein, 109 aa, Artificial Sequence
  chemically synthesized
SSELTQDPAVSVALGQTVRITCQGDSLRSYYASWYQQKPGQAPVLVIYGKNNRPSGIPDRFSGSGSGNTASLTITGAQAEDEADYYCAAWDDSLSGPVFGGGTKVTVLG

SEQ ID NO: 476 - protein, 109 aa, Artificial Sequence
  chemically synthesized
SSELTQDPAVSVALGQTVRITCQGDSLRSYYASWYQQKPGQAPVLVMYGRNERPSGVPDRFSGSKSGTSASLAISGLQPEDEANYYCAGWDDSLTGPVFGGGTKLTVLG

SEQ ID NO: 477 - protein, 245 aa, Artificial Sequence
  chemically synthesized
QVQLQESGGGLVQPGGSLRLSCAASGFSFNTYTMHWVRQAPGKGLEWVADIAYDGSTKYYADSVKGRFTISRDNAKNSLYLQMNSLRAEDTAVYYCARDAVAGEGYFDLWGRGTLVTVSSGGGGSGGGGSGGGGSQSALTQDPAVSVALGQTVRITCQGDSLRSYYASWYQQLPGTAPKLLIYRNNQRPSGVPDRFSGSKSGTSASLAISGLRSEDEADYYCAAWDDSLSAWVFGGGTKLTVLGA

SEQ ID NO: 478 - protein, 243 aa, Artificial Sequence
  chemically synthesized
QVQLQQSGGGVVQPGGSLRLSCAASEFTFSASGMHWVRQAPGKGLEWMAFIAYDGNQKFYADSVKGRFTISRDNSKNTLYLQMDSLRGEDTAVYYCAKEMQREGYFDYWGQGTLVTVSSGGGGSGGGGSGGGGSNFMLTQDPAVSVALGQTVRITCQGDSLRSYYASWYQQKPGQAPVLVIYGKNNRPSGIPDRFSGSKSGNSASLDISGLQSEDEADYYCATWDDNLSGPIFGGGTKVTVLG

SEQ ID NO: 479 - protein, 242 aa, Artificial Sequence
  chemically synthesized
QVQLAESGGGLVKPGGSLRLSCAASGFTFSDYYMSWIRQAPGKGLEWVSYISTSGSSIYYVDSVKGRFTISRDNAKNSLYLQMDSLRDDDTAVYYCARDLHGDYAFDSWGQGTLVTVSSGGGGSGGGGSGGGGSSELTQDPAVSVALGQTVRITCQGDSLRSYYASWYQQKPGQAPVLVIYGKNNRPSGIPDRFSGSKSGNSASLDISGLQSEDEADYYCATWDDNLSGPIFGGGTKVTVLG

SEQ ID NO: 480 - protein, 243 aa, Artificial Sequence
  chemically synthesized
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKVSSSWSHFDYWGQGTLVTVSSGGGGSGGGGSGGGGSDVVMTQSPSTLSASVGDRVTITCRASQYISNWLAWYQQKPGKAPKLLIYKASSLESGVPSRFSGSGSGTEFTLTISSLQPEDFATYYCQESYNTPLFTFGPGTKLEIKR

SEQ ID NO: 481 - protein, 241 aa, Artificial Sequence
  chemically synthesized
QVQLVESGGGLVEPGGSLRLSCAASGFTFSNYAINWVRQAPGKGLEWVANIHHDGNGKYYVDSVEGRFTISRDNAKNSLYLQMDSLRAEDTAIYYCARDGYGGYLDLWGQGTLVTVSSGGGGSGGGGSGGGGSSELTQDPAVSVALGQTVRITCQGDSLRSYYASWYQQKPGQAPVLVIYGKNNRPSGIPDRFSGSGSGNTASLTITGAQAEDEADYYCAAWDDSLSGPVFGGGTKVTVLG

SEQ ID NO: 482 - protein, 243 aa, Artificial Sequence
  chemically synthesized
QVQLQESGGGVVQPGRSLRLSCAASRFTFSSYAMHWVRQAPGKGLEWVAVISYDGSNKYYADSVKGRFTISRDNSKNTLYLQMNSLRAEDTAVYYCARDLSGYGDYPDYWGQGTLVTVSSGGGGSGGGGSGGGGSSELTQDPAVSVALGQTVRITCQGDSLRSYYASWYQQKPGQAPVLVMYGRNERPSGVPDRFSGSKSGTSASLAISGLQPEDEANYYCAGWDDSLTGPVFGGGTKLTVLG

SEQ ID NO: 483 - protein, 138 aa, Artificial Sequence; identical to SEQ ID NO: 458
  chemically synthesized

SEQ ID NO: 484 - protein, 130 aa, Artificial Sequence; identical to SEQ ID NO: 461
  chemically synthesized

SEQ ID NO: 485 - protein, 119 aa, Artificial Sequence
  chemically synthesized
EVQLLESGGGLVQPGGSLRLSCAASGFTFAHETMVWVRQAPGKGLEWVSHIPPVGQDPFYADSVKGRFTISRDNSKNTLYLQMNSLRAEDTAVYYCALLPKRGPWFDYWGQGTLVTVSS

SEQ ID NO: 486 - protein, 10 aa, Artificial Sequence
  chemically synthesized
NGDYGIEFDY

SEQ ID NO: 487 - protein, 249 aa, Artificial Sequence
  chemically synthesized
MASYELTQPPSVSVAPGQTARITCSGDALGNKYASWYQQKPGQAPVLVIYEDSKRPSGIPERFSGSNSGNTATLTISGTQAEDEADYYCSSGDSPCRAFGGGTKLTVLGSGGSTITSYNVYYTKLSSSGSEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARHSIYRCFFAVWGQGTLVTVSS

SEQ ID NO: 488 - protein, 6 aa, Artificial Sequence
  chemically synthesized
TSGMGL

SEQ ID NO: 489 - protein, 16 aa, Artificial Sequence
  chemically synthesized
ASIWNNDNYYNPSLKS

SEQ ID NO: 490 - protein, 15 aa, Artificial Sequence
  chemically synthesized
AWRERTMVTTSMLWT

SEQ ID NO: 491 - protein, 11 aa, Artificial Sequence
  chemically synthesized
RASENIYSYLA

SEQ ID NO: 492 - protein, 7 aa, Artificial Sequence
  chemically synthesized
KEKTLAE

SEQ ID NO: 493 - protein, 9 aa, Artificial Sequence
  chemically synthesized
QHHYGIPWT

SEQ ID NO: 494 - protein, 17 aa, Artificial Sequence
  chemically synthesized
GISTYFGRTNYNQKFKG

SEQ ID NO: 495 - protein, 10 aa, Artificial Sequence
  chemically synthesized
GLSGNYVMDY

SEQ ID NO: 496 - protein, 15 aa, Artificial Sequence
  chemically synthesized
RASESVDSYGNSFMH

SEQ ID NO: 497 - protein, 7 aa, Artificial Sequence
  chemically synthesized
RASNLES

SEQ ID NO: 498-499 - skipped (2 entries)

SEQ ID NO: 500 - protein, 9 aa, Artificial Sequence
  chemically synthesized
QQSNEAPPT

SEQ ID NO: 501 - protein, 17 aa, Artificial Sequence
  chemically synthesized
  MISC_FEATURE (4)..(4): X is F or P
VISXYSGKTNYSQNFMG

SEQ ID NO: 502 - protein, 10 aa, Artificial Sequence
  chemically synthesized
GLSGNFVVDF

SEQ ID NO: 503 - protein, 15 aa, Artificial Sequence
  chemically synthesized
RASESVDDYPNSFMH

SEQ ID NO: 504 - protein, 7 aa, Artificial Sequence
  chemically synthesized
DATNLAD

SEQ ID NO: 505 - protein, 9 aa, Artificial Sequence
  chemically synthesized
  MISC_FEATURE (6)..(6): X is G or D
QHSNEXPPT

SEQ ID NO: 506 - protein, 17 aa, Artificial Sequence
  chemically synthesized
EINPTNGRTNYIEKFKS

SEQ ID NO: 507 - protein, 13 aa, Artificial Sequence
  chemically synthesized
YGYGNPATRYFDV

SEQ ID NO: 508 - protein, 11 aa, Artificial Sequence
  chemically synthesized
RASENLYSNLA

SEQ ID NO: 509 - protein, 7 aa, Artificial Sequence
  chemically synthesized
DATDLAD

SEQ ID NO: 510 - protein, 9 aa, Artificial Sequence
  chemically synthesized
QHFWGTPLT

SEQ ID NO: 511 - protein, 17 aa, Artificial Sequence
  chemically synthesized
  MISC_FEATURE (5)..(5): X is I or S
  misc_feature (12)..(12): Xaa can be any naturally occurring amino acid
  MISC_FEATURE (13)..(13): X is N or S
  misc_feature (14)..(14): Xaa can be any naturally occurring amino acid
  MISC_FEATURE (15)..(15): X is N or t
EINPXNGRTNYXEXFKK

SEQ ID NO: 512 - protein, 11 aa, Artificial Sequence
  chemically synthesized
GGNNIGSKSVH

SEQ ID NO: 513 - protein, 11 aa, Artificial Sequence
  chemically synthesized
RASDNIYSNLA

SEQ ID NO: 514 - protein, 7 aa, Artificial Sequence
  chemically synthesized
YASIQES

SEQ ID NO: 515 - protein, 15 aa, Artificial Sequence
  chemically synthesized
GGYDSRAWFRGAMAY

SEQ ID NO: 516 - protein, 17 aa, Artificial Sequence
  chemically synthesized
NIYPGSGSTKYDERFKS

SEQ ID NO: 517 - protein, 10 aa, Artificial Sequence
  chemically synthesized
GLSGNYVVDY

SEQ ID NO: 518 - protein, 15 aa, Artificial Sequence
  chemically synthesized
RARQSVSTSSYSFMH

SEQ ID NO: 519 - protein, 7 aa, Artificial Sequence
  chemically synthesized
  MISC_FEATURE (4)..(4): X is N or R
  MISC_FEATURE (6)..(6): X is A or H
STSXLXS

SEQ ID NO: 520 - protein, 12 aa, Artificial Sequence
  chemically synthesized
  MISC_FEATURE (1)..(1): X is Q or R
  MISC_FEATURE (3)..(3): X is A ir G
  MISC_FEATURE (4)..(4): X is L or Y
  MISC_FEATURE (5)..(5): X is Y or G
  MISC_FEATURE (6)..(6): X is D or Y
  MISC_FEATURE (7)..(7): X is G or D
  MISC_FEATURE (8)..(9): X is Y or G
  MISC_FEATURE (10)..(10): X is F or Absent
XGXXXXXXXXDH

SEQ ID NO: 521 - protein, 17 aa, Artificial Sequence
  chemically synthesized
  MISC_FEATURE (1)..(1): X is S or G
  MISC_FEATURE (3)..(3): X is S or L
  MISC_FEATURE (12)..(12): X is P or N
  MISC_FEATURE (14)..(14): X is K or T
XIXNGGDNTYYXDXVKG

SEQ ID NO: 522 - protein, 10 aa, Artificial Sequence
  chemically synthesized
GLSGNFVMDF

SEQ ID NO: 523 - protein, 11 aa, Artificial Sequence
  chemically synthesized
  MISC_FEATURE (3)..(3): X is S or G
  MISC_FEATURE (5)..(5): X is V or D
  MISC_FEATURE (6)..(6): X is P or I
  MISC_FEATURE (7)..(7): X is S or T
  MISC_FEATURE (10)..(10): X is F or L
TTXSXXXNYXN

SEQ ID NO: 524 - protein, 9 aa, Artificial Sequence
  chemically synthesized
QQSNEAPPT

SEQ ID NO: 525 - protein, 17 aa, Artificial Sequence
  chemically synthesized
VISPYSGRTNYNQNFKG

SEQ ID NO: 526 - protein, 7 aa, Artificial Sequence
  chemically synthesized
GTRAYHY

SEQ ID NO: 527 - protein, 9 aa, Artificial Sequence
  chemically synthesized
QQSNEGPPT

SEQ ID NO: 528 - protein, 17 aa, Artificial Sequence
  chemically synthesized
EIAPTNGRTNYIEKFKS

SEQ ID NO: 529 - protein, 7 aa, Artificial Sequence
  chemically synthesized
GTRAYHF

SEQ ID NO: 530 - protein, 16 aa, Artificial Sequence
  chemically synthesized
GISTYFGRTNYNQKFK

SEQ ID NO: 531 - protein, 17 aa, Artificial Sequence
  chemically synthesized
VISFYSGKTNYNQKFMG

SEQ ID NO: 532 - protein, 11 aa, Artificial Sequence
  chemically synthesized
QVWDSSSDHVV

SEQ ID NO: 533 - protein, 9 aa, Artificial Sequence
  chemically synthesized
QHSNEDPPT

SEQ ID NO: 534 - protein, 17 aa, Artificial Sequence
  chemically synthesized
VISPYSGKTNYSQKFKG

SEQ ID NO: 535 - protein, 5 aa, Artificial Sequence
  chemically synthesized
SYSMN

SEQ ID NO: 536 - protein, 17 aa, Artificial Sequence
  chemically synthesized
SISSSSSYIYYADSVKG

SEQ ID NO: 537 - protein, 16 aa, Artificial Sequence
  chemically synthesized
EINPTNGRTNYIEKFK

SEQ ID NO: 538 - protein, 11 aa, Artificial Sequence
  chemically synthesized
GGYDSRAWFAY

SEQ ID NO: 539 - protein, 9 aa, Artificial Sequence
  chemically synthesized
QHFWGTPLM

SEQ ID NO: 540 - protein, 17 aa, Artificial Sequence
  chemically synthesized
EINPTNGRTNYNENFKS

SEQ ID NO: 541 - protein, 11 aa, Artificial Sequence
  chemically synthesized
GGYDSRAWFAH

SEQ ID NO: 542 - protein, 9 aa, Artificial Sequence
  chemically synthesized
QQHNEYPWT

SEQ ID NO: 543 - protein, 17 aa, Artificial Sequence
  chemically synthesized
EINPINGRTNYSEKFKK

SEQ ID NO: 544 - protein, 15 aa, Artificial Sequence
  chemically synthesized
QGALYDGYYRGAMDY

SEQ ID NO: 545 - protein, 9 aa, Artificial Sequence
  chemically synthesized
QHTWEIPFT

SEQ ID NO: 546 - protein, 16 aa, Artificial Sequence
  chemically synthesized
YISYSGTTSYNPSLKS

SEQ ID NO: 547 - protein, 12 aa, Artificial Sequence
  chemically synthesized
RGGYGYDGEFAY

SEQ ID NO: 548 - protein, 9 aa, Artificial Sequence
  chemically synthesized
HQYHRSPFT

SEQ ID NO: 549 - skipped

SEQ ID NO: 550 - protein, 9 aa, Artificial Sequence
  chemically synthesized
QQANTLPYT

SEQ ID NO: 551 - protein, 17 aa, Artificial Sequence
  chemically synthesized
NIYPGSGSTKYDEKFKS

SEQ ID NO: 552 - protein, 9 aa, Artificial Sequence
  chemically synthesized
QHTWEIPFT

SEQ ID NO: 553 - protein, 16 aa, Artificial Sequence
  chemically synthesized
SISNGGDNTYYPDTVK

SEQ ID NO: 554 - protein, 9 aa, Artificial Sequence
  chemically synthesized
  MISC_FEATURE (3)..(3): X is Y or A
  MISC_FEATURE (4)..(4): X is H or N
  MISC_FEATURE (5)..(5): X is R or T
  MISC_FEATURE (6)..(6): X is S or L
HQXXXXPYT

SEQ ID NO: 555 - protein, 17 aa, Artificial Sequence
  chemically synthesized
EILPGSGSTKYNEKFKG

SEQ ID NO: 556 - protein, 9 aa, Artificial Sequence
  chemically synthesized
QQSNEAPPT

SEQ ID NO: 557 - protein, 9 aa, Artificial Sequence
  chemically synthesized
QHFAGTPLT

SEQ ID NO: 558 - protein, 10 aa, Artificial Sequence
  chemically synthesized
GFTFSNYGMH

SEQ ID NO: 559 - protein, 17 aa, Artificial Sequence
  chemically synthesized
MIYYDSSKMNYADTVKG

SEQ ID NO: 560 - protein, 9 aa, Artificial Sequence
  chemically synthesized
PTSHYVVDV

SEQ ID NO: 561 - protein, 10 aa, Artificial Sequence
  chemically synthesized
GFTFSNYGMH

SEQ ID NO: 562 - protein, 10 aa, Artificial Sequence
  chemically synthesized
ARESVDAFDI

SEQ ID NO: 563 - protein, 9 aa, Artificial Sequence
  chemically synthesized
PTSHYVVDV

SEQ ID NO: 564 - protein, 10 aa, Artificial Sequence
  chemically synthesized
GYTFTNYDIH

SEQ ID NO: 565 - protein, 11 aa, Artificial Sequence
  chemically synthesized
QGDSLRSYDAS

SEQ ID NO: 566 - protein, 9 aa, Artificial Sequence
  chemically synthesized
PTSHYVVDV

SEQ ID NO: 567 - protein, 17 aa, Artificial Sequence
  chemically synthesized
WIYPGDGSTKYNEKFKG

SEQ ID NO: 568-577 - skipped (10 entries)

SEQ ID NO: 578 - protein, 8 aa, Artificial Sequence
  chemically synthesized
YWGQGTTV

SEQ ID NO: 579 - protein, 5 aa, Artificial Sequence
  chemically synthesized
TYTMH

SEQ ID NO: 580 - protein, 17 aa, Artificial Sequence
  chemically synthesized
DIAYDGSTKYYADSVKG

SEQ ID NO: 581 - protein, 11 aa, Artificial Sequence
  chemically synthesized
DAVAGEGYFDL

SEQ ID NO: 582 - protein, 11 aa, Artificial Sequence
  chemically synthesized
QGDSLRSYYAS

SEQ ID NO: 583 - protein, 7 aa, Artificial Sequence
  chemically synthesized
RNNQRPS

SEQ ID NO: 584 - protein, 11 aa, Artificial Sequence
  chemically synthesized
AAWDDSLSAWV

SEQ ID NO: 585 - protein, 5 aa, Artificial Sequence
  chemically synthesized
ASGMH

SEQ ID NO: 586 - protein, 17 aa, Artificial Sequence
  chemically synthesized
FIAYDGNQKFYADSVKG

SEQ ID NO: 587 - protein, 10 aa, Artificial Sequence
  chemically synthesized
EMQREGYFDY

SEQ ID NO: 588 - protein, 7 aa, Artificial Sequence
  chemically synthesized
GLSDRPS

SEQ ID NO: 589 - protein, 7 aa, Artificial Sequence
  chemically synthesized
GKNNRPS

SEQ ID NO: 590 - protein, 11 aa, Artificial Sequence
  chemically synthesized
ATWDDNLSGPI

SEQ ID NO: 591 - protein, 5 aa, Artificial Sequence
  chemically synthesized
DYYMS

SEQ ID NO: 592 - protein, 17 aa, Artificial Sequence
  chemically synthesized
YISTSGSSIYYVDSVKG

SEQ ID NO: 593 - protein, 10 aa, Artificial Sequence
  chemically synthesized
DLHGDYAFDS

SEQ ID NO: 594 - protein, 10 aa, Artificial Sequence
  chemically synthesized
ISRDSGGNPH

SEQ ID NO: 595 - protein, 13 aa, Artificial Sequence
  chemically synthesized
GYYGSNYYYGMDV

SEQ ID NO: 596 - protein, 13 aa, Artificial Sequence
  chemically synthesized
SGSSSNIGSNYVY

SEQ ID NO: 597 - protein, 5 aa, Artificial Sequence
  chemically synthesized
SYAMS

SEQ ID NO: 598 - protein, 17 aa, Artificial Sequence
  chemically synthesized
AISGSGGSTYYADSVKG

SEQ ID NO: 599 - protein, 10 aa, Artificial Sequence
  chemically synthesized
VSSSWSHFDY

SEQ ID NO: 600 - protein, 11 aa, Artificial Sequence
  chemically synthesized
RASQYISNWLA

SEQ ID NO: 601 - protein, 7 aa, Artificial Sequence
  chemically synthesized
KASSLES

SEQ ID NO: 602 - protein, 10 aa, Artificial Sequence
  chemically synthesized
QESYNTPLFT

SEQ ID NO: 603 - protein, 5 aa, Artificial Sequence
  chemically synthesized
NYAIN

SEQ ID NO: 604 - protein, 17 aa, Artificial Sequence
  chemically synthesized
NIHHDGNGKYYVDSVEG

SEQ ID NO: 605 - protein, 9 aa, Artificial Sequence
  chemically synthesized
DGYGGYLDL

SEQ ID NO: 606 - protein, 5 aa, Artificial Sequence
  chemically synthesized
DFVFS

SEQ ID NO: 607 - protein, 17 aa, Artificial Sequence
  chemically synthesized
WISAHDGNTNYAQKLQD

SEQ ID NO: 608 - protein, 11 aa, Artificial Sequence
  chemically synthesized
AAWDDSLSGPV

SEQ ID NO: 609 - protein, 5 aa, Artificial Sequence
  chemically synthesized
SYAMH

SEQ ID NO: 610 - protein, 17 aa, Artificial Sequence
  chemically synthesized
VISYDGSNKYYADSVKG

SEQ ID NO: 611 - protein, 11 aa, Artificial Sequence
  chemically synthesized
DLSGYGDYPDY

SEQ ID NO: 612 - protein, 17 aa, Artificial Sequence
  chemically synthesized
DTFTNLLGDYSYDAMDV

SEQ ID NO: 613 - protein, 7 aa, Artificial Sequence
  chemically synthesized
GRNERPS

SEQ ID NO: 614 - protein, 11 aa, Artificial Sequence
  chemically synthesized
AGWDDSLTGPV

SEQ ID NO: 615 - protein, 8 aa, Artificial Sequence
  chemically synthesized
PRFKIIGG

SEQ ID NO: 616 - protein, 8 aa, Artificial Sequence
  chemically synthesized
PRFRIIGG

SEQ ID NO: 617 - protein, 9 aa, Artificial Sequence
  chemically synthesized
SSRHRRALD

SEQ ID NO: 618 - protein, 14 aa, Artificial Sequence
  chemically synthesized
RKSSIIIRMRDVVL

SEQ ID NO: 619 - protein, 15 aa, Artificial Sequence
  chemically synthesized
SSSFDKGKYKKGDDA

SEQ ID NO: 620 - protein, 15 aa, Artificial Sequence
  chemically synthesized
SSSFDKGKYKRGDDA

SEQ ID NO: 621 - protein, 4 aa, Artificial Sequence
  chemically synthesized
IEGR

SEQ ID NO: 622 - protein, 4 aa, Artificial Sequence
  chemically synthesized
IDGR

SEQ ID NO: 623 - protein, 7 aa, Artificial Sequence
  chemically synthesized
GGSIDGR

SEQ ID NO: 624 - protein, 6 aa, Artificial Sequence
  chemically synthesized
PLGLWA

SEQ ID NO: 625 - protein, 8 aa, Artificial Sequence
  chemically synthesized
GPQGIAGQ

SEQ ID NO: 626 - protein, 8 aa, Artificial Sequence
  chemically synthesized
GPQGLLGA

SEQ ID NO: 627 - protein, 5 aa, Artificial Sequence
  chemically synthesized
GIAGQ

SEQ ID NO: 628 - protein, 8 aa, Artificial Sequence
  chemically synthesized
GPLGIAGI

SEQ ID NO: 629 - protein, 8 aa, Artificial Sequence
  chemically synthesized
GPEGLRVG

SEQ ID NO: 630 - protein, 8 aa, Artificial Sequence
  chemically synthesized
YGAGLGVV

SEQ ID NO: 631 - protein, 8 aa, Artificial Sequence
  chemically synthesized
AGLGVVER

SEQ ID NO: 632 - protein, 8 aa, Artificial Sequence
  chemically synthesized
AGLGISST

SEQ ID NO: 633 - protein, 8 aa, Artificial Sequence
  chemically synthesized
EPQALAMS

SEQ ID NO: 634 - protein, 8 aa, Artificial Sequence
  chemically synthesized
QALAMSAI

SEQ ID NO: 635 - protein, 8 aa, Artificial Sequence
  chemically synthesized
AAYHLVSQ

SEQ ID NO: 636 - protein, 8 aa, Artificial Sequence
  chemically synthesized
MDAFLESS

SEQ ID NO: 637 - protein, 8 aa, Artificial Sequence
  chemically synthesized
ESLPVVAV

SEQ ID NO: 638 - protein, 8 aa, Artificial Sequence
  chemically synthesized
SAPAVESE

SEQ ID NO: 639 - protein, 8 aa, Artificial Sequence
  chemically synthesized
DVAQFVLT

SEQ ID NO: 640 - protein, 8 aa, Artificial Sequence
  chemically synthesized
VAQFVLTE

SEQ ID NO: 641 - protein, 8 aa, Artificial Sequence
  chemically synthesized
AQFVLTEG

SEQ ID NO: 642 - protein, 8 aa, Artificial Sequence
  chemically synthesized
PVQPIGPQ

SEQ ID NO: 643 - protein, 273 aa, Artificial Sequence
  chemically synthesized
GGGSGGGGSGSGGGSGGGGSGGGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRSGGSTITSYNVYYTKLSSSGTQVQLVQTGGGVVQPGRSLRLSCAASGSTFSSYAMSWVRQAPGKGLEWVSAISGSGGSTYYADSVKGRFTISRDNSKNTLYLQMNSLRAEDTAVYYCATNSLYWYFDLWGRGTLVTVSSAS

SEQ ID NO: 644 - protein, 264 aa, Artificial Sequence
  chemically synthesized
GGGSGGGGSGSGGGSGGGGSGGGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 645 - protein, 7 aa, Artificial Sequence
  chemically synthesized
QGQSGQG

SEQ ID NO: 646 - protein, 5 aa, Artificial Sequence
  chemically synthesized
QGQSG

SEQ ID NO: 647 - protein, 4 aa, Artificial Sequence
  chemically synthesized
QGQS

SEQ ID NO: 648 - protein, 3 aa, Artificial Sequence
  chemically synthesized
QGQ

SEQ ID NO: 649 - protein, 2 aa, Artificial Sequence
  chemically synthesized
QG

SEQ ID NO: 650 - protein, 253 aa, Artificial Sequence
  chemically synthesized
QFCPWSYYLIGDCDIGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 651 - DNA, 759 bp, Artificial Sequence
  chemically synthesized
cagttctgcccttggtcctactacctgatcggcgactgcgacatcggcggaggctcctccggcggctccatctcctctggcctgctgtccggcagatccgacaaccacggcggtggcagcgacatccagatgacccagtccccatccagcctgtccgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctcccagcgtgttcatcttcccaccctccgacgagcagctgaagtccggcaccgccagcgtcgtgtgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccgcggcgagtgc

SEQ ID NO: 652 - protein, 257 aa, Artificial Sequence
  chemically synthesized
QFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 653 - DNA, 771 bp, Artificial Sequence
  chemically synthesized
cagttctgcccttggtcctactacctgatcggcgactgcgacatcggcggaggctcctctggcggctctgctgtgggcctgctggctccacctggcggcctgtccggcagatctgacaaccacggcggctccgacatccagatgacccagtccccctccagcctgtccgcctccgtgggcgacagagtgacaatcacctgttccgccagctcctccgtgtactacatgtactggttccagcagaagcccggaaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctccttccgtgttcatcttcccaccctccgacgagcagctgaagagcggcaccgccagcgtggtctgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 654 - protein, 253 aa, Artificial Sequence
  chemically synthesized
NLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 655 - DNA, 759 bp, Artificial Sequence
  chemically synthesized
aacctgtgcaccgagcactctgccgctctggactgcagatcctacggcggaggctcctccggcggctccatctcctctggcctgctgtccggcagatccgacaaccatggcggcggatccgacatccagatgacccagtccccctccagcctgtccgcctccgtgggcgacagagtgacaatcacctgttccgccagctcctccgtgtactacatgtactggttccagcagaagcccggcaaggcccccaagctgtggatctactccaccagcaacctggcctccggcgtgccctccagattctccggctctggctccggcaccgactacaccctgaccatctccagcatgcagcccgaggacttcgccacctactactgccagcagcggcggaactacccctacaccttcggacagggcaccaagctggaaatcaagcggaccgtggccgctcccagcgtgttcatcttcccaccctccgacgagcagctgaagtccggcaccgccagcgtggtctgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 656 - protein, 257 aa, Artificial Sequence
  chemically synthesized
NLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 657 - DNA, 771 bp, Artificial Sequence
  chemically synthesized
aacctgtgcaccgagcactctgccgctctggactgcagatcctacggcggaggctcctctggcggctctgctgtgggcctgctggctccacctggcggcctgtccggcagatctgacaaccacggcggctccgacatccagatgacccagtccccctccagcctgtctgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggacagggcaccaagctggaaatcaagcggaccgtggccgctccctccgtgttcatcttcccaccctccgacgagcagctgaagtccggcaccgccagcgtggtctgcctgctgaacaacttctacccccgcgaggccaaggtgcagtggaaggtggacaacgccctgcagtccggcaactcccaggaatccgtcaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 658 - protein, 248 aa, Artificial Sequence
  chemically synthesized
CTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 659 - DNA, 744 bp, Artificial Sequence
  chemically synthesized
tgcaccgagcacagcttcgccctggactgtggcggcggatcctccggcggctccatctcctctggcctgctgtccggcagatccgacaaccacggcggaggctccgacatccagatgacccagtccccctccagcctgtccgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctccctccgtgttcatcttcccaccctccgacgagcagctgaagtccggcaccgccagcgtggtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 660 - protein, 252 aa, Artificial Sequence
  chemically synthesized
CTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 661 - DNA, 756 bp, Artificial Sequence
  chemically synthesized
tgcaccgagcacagcttcgccctggactgtggcggcggatcttctggcggctctgctgtgggcctgctggctcctcctggcggcctgtccggcagatctgacaaccacggcggctccgacatccagatgacccagtccccctccagcctgtccgcctccgtgggcgacagagtgacaatcacctgttccgccagctcctccgtgtactacatgtactggttccagcagaagcccggcaaggcccccaagctgtggatctactccacctccaacctggcctccggcgtgccctccagattctccggctctggctccggcaccgactacaccctgaccatctccagcatgcagcccgaggacttcgccacctactactgccagcagcggcggaactacccctacaccttcggccagggcaccaagctggaaatcaagcggaccgtggccgctccctccgtgttcatcttcccaccctccgacgagcagctgaagtccggcaccgccagcgtggtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgc

SEQ ID NO: 662 - DNA, 21 bp, Artificial Sequence
  chemically synthesized
cagggccagtccggccaggga

SEQ ID NO: 663 - DNA, 21 bp, Artificial Sequence
  chemically synthesized
cagggacagtctggccagggc

SEQ ID NO: 664 - DNA, 21 bp, Artificial Sequence
  chemically synthesized
cagggccagtctggacagggc

SEQ ID NO: 665 - DNA, 21 bp, Artificial Sequence
  chemically synthesized
cagggccagtctggccagggc

SEQ ID NO: 666 - protein, 6 aa, Artificial Sequence
  chemically synthesized
GQSGQG

SEQ ID NO: 667 - protein, 5 aa, Artificial Sequence
  chemically synthesized
QSGQG

SEQ ID NO: 668 - protein, 4 aa, Artificial Sequence
  chemically synthesized
SGQG

SEQ ID NO: 669 - protein, 3 aa, Artificial Sequence
  chemically synthesized
GQG

SEQ ID NO: 670 - protein, 253 aa, Artificial Sequence
  chemically synthesized
NLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 671 - protein, 260 aa, Artificial Sequence
  chemically synthesized
QGQSGQGNLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 672 - protein, 257 aa, Artificial Sequence
  chemically synthesized
NLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 673 - protein, 264 aa, Artificial Sequence
  chemically synthesized
QGQSGQGNLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 674 - DNA, 21 bp, Artificial Sequence
  chemically synthesized
cagggacagtcaggccagggc

SEQ ID NO: 675 - DNA, 759 bp, Artificial Sequence
  chemically synthesized
aatctctgcacggagcatagcgccgcacttgactgtcgatcttacggcggcggttcctctggaggctctatatcatccggactcctctcaggcagaagcgctaatcctggcggcggatctgatatacaaatgactcagtcaccaagctccctgagtgcgtcagttggtgatagggtgacgatcacttgtagtgcgagctcatctgtttattatatgtactggtttcaacagaaacccggaaaagcacctaagttgtggatctacagtacctccaatctggcttccggcgtccccagccggttttccggctctggaagcggaacggattacacgctcaccatatcctctatgcaacctgaagatttcgcaacttactactgtcagcaacgcaggaattatccatatacatttggtcaagggactaagctcgaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 676 - DNA, 780 bp, Artificial Sequence
  chemically synthesized
cagggacagtcaggccagggcaatctctgcacggagcatagcgccgcacttgactgtcgatcttacggcggcggttcctctggaggctctatatcatccggactcctctcaggcagaagcgctaatcctggcggcggatctgatatacaaatgactcagtcaccaagctccctgagtgcgtcagttggtgatagggtgacgatcacttgtagtgcgagctcatctgtttattatatgtactggtttcaacagaaacccggaaaagcacctaagttgtggatctacagtacctccaatctggcttccggcgtccccagccggttttccggctctggaagcggaacggattacacgctcaccatatcctctatgcaacctgaagatttcgcaacttactactgtcagcaacgcaggaattatccatatacatttggtcaagggactaagctcgaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 677 - DNA, 21 bp, Artificial Sequence
  chemically synthesized
caagggcagtccggtcaaggg

SEQ ID NO: 678 - DNA, 771 bp, Artificial Sequence
  chemically synthesized
aacttgtgtacagagcattctgccgcccttgactgcaggtcttacggcggagggagtagtggcgggagcgcggtgggacttctggcaccacctggtgggttgtcaggcaggagcgacaatccaggggggtcagacatccagatgacacaaagtccgagtagtctctcagctagtgtgggcgatagagtcacaattacatgtagtgcgtccagtagcgtgtactacatgtactggtttcagcagaagccgggcaaagcaccgaaactgtggatttacagtaccagcaacctcgccagcggtgttccctctcgattttcagggagtgggagtgggaccgactacacgctcaccatctcaagtatgcagccagaagatttcgctacctactattgccagcagcggcggaattatccctacacgttcggtcaaggcacaaaactggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 679 - DNA, 792 bp, Artificial Sequence
  chemically synthesized
caagggcagtccggtcaagggaacttgtgtacagagcattctgccgcccttgactgcaggtcttacggcggagggagtagtggcgggagcgcggtgggacttctggcaccacctggtgggttgtcaggcaggagcgacaatccaggggggtcagacatccagatgacacaaagtccgagtagtctctcagctagtgtgggcgatagagtcacaattacatgtagtgcgtccagtagcgtgtactacatgtactggtttcagcagaagccgggcaaagcaccgaaactgtggatttacagtaccagcaacctcgccagcggtgttccctctcgattttcagggagtgggagtgggaccgactacacgctcaccatctcaagtatgcagccagaagatttcgctacctactattgccagcagcggcggaattatccctacacgttcggtcaaggcacaaaactggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 680 - protein, 15 aa, Artificial Sequence
  chemically synthesized
ISSGLLSGRSANPRG

SEQ ID NO: 681 - protein, 18 aa, Artificial Sequence
  chemically synthesized
AVGLLAPPTSGRSANPRG

SEQ ID NO: 682 - protein, 17 aa, Artificial Sequence
  chemically synthesized
AVGLLAPPSGRSANPRG

SEQ ID NO: 683 - protein, 13 aa, Artificial Sequence
  chemically synthesized
ISSGLLSGRSDDH

SEQ ID NO: 684 - protein, 13 aa, Artificial Sequence
  chemically synthesized
ISSGLLSGRSDIH

SEQ ID NO: 685 - protein, 13 aa, Artificial Sequence
  chemically synthesized
ISSGLLSGRSDQH

SEQ ID NO: 686 - protein, 13 aa, Artificial Sequence
  chemically synthesized
ISSGLLSGRSDTH

SEQ ID NO: 687 - protein, 13 aa, Artificial Sequence
  chemically synthesized
ISSGLLSGRSDYH

SEQ ID NO: 688 - protein, 13 aa, Artificial Sequence
  chemically synthesized
ISSGLLSGRSDNP

SEQ ID NO: 689 - protein, 13 aa, Artificial Sequence
  chemically synthesized
ISSGLLSGRSANP

SEQ ID NO: 690 - protein, 13 aa, Artificial Sequence
  chemically synthesized
ISSGLLSGRSANI

SEQ ID NO: 691 - protein, 18 aa, Artificial Sequence
  chemically synthesized
AVGLLAPPGGLSGRSDDH

SEQ ID NO: 692 - protein, 18 aa, Artificial Sequence
  chemically synthesized
AVGLLAPPGGLSGRSDIH

SEQ ID NO: 693 - protein, 18 aa, Artificial Sequence
  chemically synthesized
AVGLLAPPGGLSGRSDQH

SEQ ID NO: 694 - protein, 18 aa, Artificial Sequence
  chemically synthesized
AVGLLAPPGGLSGRSDTH

SEQ ID NO: 695 - protein, 18 aa, Artificial Sequence
  chemically synthesized
AVGLLAPPGGLSGRSDYH

SEQ ID NO: 696 - protein, 18 aa, Artificial Sequence
  chemically synthesized
AVGLLAPPGGLSGRSDNP

SEQ ID NO: 697 - protein, 18 aa, Artificial Sequence
  chemically synthesized
AVGLLAPPGGLSGRSANP

SEQ ID NO: 698 - protein, 18 aa, Artificial Sequence
  chemically synthesized
AVGLLAPPGGLSGRSANI

SEQ ID NO: 699 - protein, 447 aa, Artificial Sequence
  chemically synthesized
QVQLVQSGAEVKKPGASVKMSCKASGYTFTSYWMHWVRQAPGQGLEWIGAIYPGNSETGYAQKFQGRATLTADTSTSTAYMELSSLRSEDTAVYYCTRENWDPGFAFWGQGTLITVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 700 - DNA, 1341 bp, Artificial Sequence
  chemically synthesized
caggtgcagctggtgcagtctggcgccgaagtgaagaaacctggcgcctccgtgaagatgtcctgcaaggcctccggctacaccttcaccagctactggatgcactgggtgcgacaggctccaggccagggcctcgaatggatcggcgccatctaccccggcaactccgagacaggctacgcccagaagttccagggcagagccaccctgaccgccgacacctccacctccaccgcctacatggaactgtccagcctgcggagcgaggacaccgccgtgtactactgcaccagagagaactgggaccccggcttcgccttctggggccagggcaccctgatcaccgtgtcctccgccagcaccaagggcccctccgtgttccctctggccccttccagcaagtccacctctggcggcacagctgccctgggctgcctggtgaaagactacttccccgagcccgtgaccgtgtcctggaactctggcgccctgaccagcggagtgcacaccttccctgccgtgctgcagtcctccggcctgtactccctgtcctccgtggtgacagtgccctcctccagcctgggcacccagacctacatctgcaacgtgaaccacaagccctccaacaccaaggtggacaagaaggtggaacccaagtcctgcgacaagacccacacctgtcctccctgccctgcccctgaactgctgggcggaccttccgtgtttctgttccccccaaagcccaaggacaccctgatgatctcccggacccccgaagtgacctgcgtggtggtggacgtgtcccacgaggaccctgaagtgaagttcaattggtacgtggacggcgtggaagtgcacaacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatctccaaggccaagggccagccccgcgagccccaggtgtacacactgccacctagccgggaagagatgaccaagaaccaggtgtccctgacctgtctggtgaaaggcttctacccctccgatatcgccgtggaatgggagagcaacggccagcccgagaacaactacaagaccaccccacctgtgctggactccgacggctcattcttcctgtactccaagctgaccgtggacaagtcccggtggcagcagggcaacgtgttctcctgcagcgtgatgcacgaggccctgcacaaccactacacccagaagtccctgtccctgagccccggc

SEQ ID NO: 701 - protein, 253 aa, Artificial Sequence
  chemically synthesized
NLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 702 - protein, 260 aa, Artificial Sequence
  chemically synthesized
QGQSGQGNLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 703 - protein, 257 aa, Artificial Sequence
  chemically synthesized
NLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 704 - protein, 264 aa, Artificial Sequence
  chemically synthesized
QGQSGQGNLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 705 - protein, 248 aa, Artificial Sequence
  chemically synthesized
CTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 706 - protein, 255 aa, Artificial Sequence
  chemically synthesized
QGQSGQGCTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 707 - protein, 252 aa, Artificial Sequence
  chemically synthesized
CTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 708 - protein, 259 aa, Artificial Sequence
  chemically synthesized
QGQSGQGCTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 709 - protein, 248 aa, Artificial Sequence
  chemically synthesized
CTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 710 - protein, 255 aa, Artificial Sequence
  chemically synthesized
QGQSGQGCTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 711 - protein, 252 aa, Artificial Sequence
  chemically synthesized
CTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 712 - protein, 259 aa, Artificial Sequence
  chemically synthesized
QGQSGQGCTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 713 - protein, 13 aa, Artificial Sequence
  chemically synthesized
ISSGLLSGRSDNI

SEQ ID NO: 714 - protein, 18 aa, Artificial Sequence
  chemically synthesized
AVGLLAPPGGLSGRSDNI

SEQ ID NO: 715 - protein, 253 aa, Artificial Sequence
  chemically synthesized
NLCTEHSAALDCRSYGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 716 - protein, 260 aa, Artificial Sequence
  chemically synthesized
QGQSGQGNLCTEHSAALDCRSYGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 717 - DNA, 21 bp, Artificial Sequence
  chemically synthesized
caaggccagtctggccagggt

SEQ ID NO: 718 - DNA, 759 bp, Artificial Sequence
  chemically synthesized
aatttgtgcacggagcatagtgcagctctggattgccggagttatggaggtggctcgagcggaggcagcggaggttcaggcgggagcggtggggggtcaggaggtggctctggaggctcagacatccagatgacccagtccccctcttccctctctgccagcgtgggtgatcgagtgacaattacatgttccgcctcttctagcgtatactatatgtactggtttcagcagaaacctggaaaagcccccaaactgtggatctattctactagcaacctggcctccggagtcccatcccggttctctggcagcggttctggaaccgactacactctgaccatctcttctatgcaaccagaggactttgctacttactactgtcaacagagaaggaactatccttatactttcggtcagggaactaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 719 - DNA, 780 bp, Artificial Sequence
  chemically synthesized
caaggccagtctggccagggtaatttgtgcacggagcatagtgcagctctggattgccggagttatggaggtggctcgagcggaggcagcggaggttcaggcgggagcggtggggggtcaggaggtggctctggaggctcagacatccagatgacccagtccccctcttccctctctgccagcgtgggtgatcgagtgacaattacatgttccgcctcttctagcgtatactatatgtactggtttcagcagaaacctggaaaagcccccaaactgtggatctattctactagcaacctggcctccggagtcccatcccggttctctggcagcggttctggaaccgactacactctgaccatctcttctatgcaaccagaggactttgctacttactactgtcaacagagaaggaactatccttatactttcggtcagggaactaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 720 - protein, 248 aa, Artificial Sequence
  chemically synthesized
CTEHSFALDCGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 721 - protein, 253 aa, Artificial Sequence
  chemically synthesized
NLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 722 - protein, 260 aa, Artificial Sequence
  chemically synthesized
QGQSGQGNLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 723 - protein, 253 aa, Artificial Sequence
  chemically synthesized
NLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 724 - protein, 260 aa, Artificial Sequence
  chemically synthesized
QGQSGQGNLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 725 - protein, 253 aa, Artificial Sequence
  chemically synthesized
NLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 726 - protein, 260 aa, Artificial Sequence
  chemically synthesized
QGQSGQGNLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 727 - protein, 257 aa, Artificial Sequence
  chemically synthesized
NLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 728 - protein, 264 aa, Artificial Sequence
  chemically synthesized
QGQSGQGNLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 729 - protein, 257 aa, Artificial Sequence
  chemically synthesized
NLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 730 - protein, 264 aa, Artificial Sequence
  chemically synthesized
QGQSGQGNLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 731 - protein, 257 aa, Artificial Sequence
  chemically synthesized
NLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 732 - protein, 264 aa, Artificial Sequence
  chemically synthesized
QGQSGQGNLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 733 - protein, 248 aa, Artificial Sequence
  chemically synthesized
CTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 734 - protein, 255 aa, Artificial Sequence
  chemically synthesized
QGQSGQGCTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 735 - protein, 248 aa, Artificial Sequence
  chemically synthesized
CTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 736 - protein, 255 aa, Artificial Sequence
  chemically synthesized
QGQSGQGCTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 737 - protein, 248 aa, Artificial Sequence
  chemically synthesized
CTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 738 - protein, 255 aa, Artificial Sequence
  chemically synthesized
QGQSGQGCTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 739 - protein, 252 aa, Artificial Sequence
  chemically synthesized
CTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 740 - protein, 259 aa, Artificial Sequence
  chemically synthesized
QGQSGQGCTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 741 - protein, 252 aa, Artificial Sequence
  chemically synthesized
CTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 742 - protein, 259 aa, Artificial Sequence
  chemically synthesized
QGQSGQGCTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 743 - protein, 252 aa, Artificial Sequence
  chemically synthesized
CTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 744 - protein, 259 aa, Artificial Sequence
  chemically synthesized
QGQSGQGCTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 745 - protein, 253 aa, Artificial Sequence
  chemically synthesized
QFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 746 - protein, 260 aa, Artificial Sequence
  chemically synthesized
QGQSGQGQFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 747 - protein, 257 aa, Artificial Sequence
  chemically synthesized
QFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 748 - protein, 264 aa, Artificial Sequence
  chemically synthesized
QGQSGQGQFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 749 - protein, 253 aa, Artificial Sequence
  chemically synthesized
QFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 750 - protein, 260 aa, Artificial Sequence
  chemically synthesized
QGQSGQGQFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 751 - protein, 257 aa, Artificial Sequence
  chemically synthesized
QFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 752 - protein, 264 aa, Artificial Sequence
  chemically synthesized
QGQSGQGQFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 753 - protein, 253 aa, Artificial Sequence
  chemically synthesized
QFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 754 - protein, 260 aa, Artificial Sequence
  chemically synthesized
QGQSGQGQFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 755 - protein, 257 aa, Artificial Sequence
  chemically synthesized
QFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 756 - protein, 264 aa, Artificial Sequence
  chemically synthesized
QGQSGQGQFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 757 - protein, 253 aa, Artificial Sequence
  chemically synthesized
QFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 758 - protein, 260 aa, Artificial Sequence
  chemically synthesized
QGQSGQGQFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 759 - protein, 257 aa, Artificial Sequence
  chemically synthesized
QFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 760 - protein, 264 aa, Artificial Sequence
  chemically synthesized
QGQSGQGQFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 761 - protein, 253 aa, Artificial Sequence
  chemically synthesized
QFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 762 - protein, 260 aa, Artificial Sequence
  chemically synthesized
QGQSGQGQFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 763 - protein, 257 aa, Artificial Sequence
  chemically synthesized
QFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 764 - protein, 264 aa, Artificial Sequence
  chemically synthesized
QGQSGQGQFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 765 - protein, 253 aa, Artificial Sequence
  chemically synthesized
NLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 766 - protein, 260 aa, Artificial Sequence
  chemically synthesized
QGQSGQGNLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 767 - protein, 257 aa, Artificial Sequence
  chemically synthesized
NLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 768 - protein, 264 aa, Artificial Sequence
  chemically synthesized
QGQSGQGNLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 769 - protein, 253 aa, Artificial Sequence
  chemically synthesized
NLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 770 - protein, 260 aa, Artificial Sequence
  chemically synthesized
QGQSGQGNLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 771 - protein, 257 aa, Artificial Sequence
  chemically synthesized
NLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 772 - protein, 264 aa, Artificial Sequence
  chemically synthesized
QGQSGQGNLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 773 - protein, 253 aa, Artificial Sequence
  chemically synthesized
NLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 774 - protein, 260 aa, Artificial Sequence
  chemically synthesized
QGQSGQGNLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 775 - protein, 257 aa, Artificial Sequence
  chemically synthesized
NLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 776 - protein, 264 aa, Artificial Sequence
  chemically synthesized
QGQSGQGNLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 777 - protein, 253 aa, Artificial Sequence
  chemically synthesized
NLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 778 - protein, 260 aa, Artificial Sequence
  chemically synthesized
QGQSGQGNLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 779 - protein, 257 aa, Artificial Sequence
  chemically synthesized
NLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 780 - protein, 264 aa, Artificial Sequence
  chemically synthesized
QGQSGQGNLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 781 - protein, 253 aa, Artificial Sequence
  chemically synthesized
NLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 782 - protein, 260 aa, Artificial Sequence
  chemically synthesized
QGQSGQGNLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 783 - protein, 257 aa, Artificial Sequence
  chemically synthesized
NLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 784 - protein, 264 aa, Artificial Sequence
  chemically synthesized
QGQSGQGNLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 785 - protein, 253 aa, Artificial Sequence
  chemically synthesized
NLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 786 - protein, 260 aa, Artificial Sequence
  chemically synthesized
QGQSGQGNLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 787 - protein, 257 aa, Artificial Sequence
  chemically synthesized
NLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 788 - protein, 264 aa, Artificial Sequence
  chemically synthesized
QGQSGQGNLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 789 - protein, 8 aa, Artificial Sequence
  chemically synthesized
LSGRSGNH

SEQ ID NO: 790 - protein, 9 aa, Artificial Sequence
  chemically synthesized
SGRSANPRG

SEQ ID NO: 791 - protein, 8 aa, Artificial Sequence
  chemically synthesized
LSGRSDDH

SEQ ID NO: 792 - protein, 8 aa, Artificial Sequence
  chemically synthesized
LSGRSDIH

SEQ ID NO: 793 - protein, 8 aa, Artificial Sequence
  chemically synthesized
LSGRSDQH

SEQ ID NO: 794 - protein, 8 aa, Artificial Sequence
  chemically synthesized
LSGRSDTH

SEQ ID NO: 795 - protein, 8 aa, Artificial Sequence
  chemically synthesized
LSGRSDYH

SEQ ID NO: 796 - protein, 8 aa, Artificial Sequence
  chemically synthesized
LSGRSDNP

SEQ ID NO: 797 - protein, 8 aa, Artificial Sequence
  chemically synthesized
LSGRSANP

SEQ ID NO: 798 - protein, 8 aa, Artificial Sequence
  chemically synthesized
LSGRSANI

SEQ ID NO: 799 - protein, 8 aa, Artificial Sequence
  chemically synthesized
LSGRSDNI

SEQ ID NO: 800 - protein, 8 aa, Artificial Sequence
  chemically synthesized
MIAPVAYR

SEQ ID NO: 801 - protein, 8 aa, Artificial Sequence
  chemically synthesized
RPSPMWAY

SEQ ID NO: 802 - protein, 8 aa, Artificial Sequence
  chemically synthesized
WATPRPMR

SEQ ID NO: 803 - protein, 8 aa, Artificial Sequence
  chemically synthesized
FRLLDWQW

SEQ ID NO: 804 - protein, 5 aa, Artificial Sequence
  chemically synthesized
ISSGL

SEQ ID NO: 805 - protein, 7 aa, Artificial Sequence
  chemically synthesized
ISSGLLS

SEQ ID NO: 806 - protein, 6 aa, Artificial Sequence
  chemically synthesized
ISSGLL

SEQ ID NO: 807 - protein, 19 aa, Artificial Sequence
  chemically synthesized
GLSGRSDNHGGAVGLLAPP

SEQ ID NO: 808 - protein, 21 aa, Artificial Sequence
  chemically synthesized
GLSGRSDNHGGVHMPLGFLGP

SEQ ID NO: 809 - protein, 146 aa, Artificial Sequence
  chemically synthesized
QFCPWSYYLIGDCDIGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 810 - protein, 153 aa, Artificial Sequence
  chemically synthesized
QGQSGQGQFCPWSYYLIGDCDIGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 811 - protein, 150 aa, Artificial Sequence
  chemically synthesized
QFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 812 - protein, 157 aa, Artificial Sequence
  chemically synthesized
QGQSGQGQFCPWSYYLIGDCDIGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 813 - protein, 146 aa, Artificial Sequence
  chemically synthesized
NLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 814 - protein, 153 aa, Artificial Sequence
  chemically synthesized
QGQSGQGNLCTEHSAALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 815 - protein, 150 aa, Artificial Sequence
  chemically synthesized
NLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 816 - protein, 157 aa, Artificial Sequence
  chemically synthesized
QGQSGQGNLCTEHSAALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 817 - protein, 141 aa, Artificial Sequence
  chemically synthesized
CTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 818 - protein, 148 aa, Artificial Sequence
  chemically synthesized
QGQSGQGCTEHSFALDCGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 819 - protein, 145 aa, Artificial Sequence
  chemically synthesized
CTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 820 - protein, 152 aa, Artificial Sequence
  chemically synthesized
QGQSGQGCTEHSFALDCGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 821 - protein, 146 aa, Artificial Sequence
  chemically synthesized
NLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 822 - protein, 153 aa, Artificial Sequence
  chemically synthesized
QGQSGQGNLCTEHSAALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 823 - protein, 150 aa, Artificial Sequence
  chemically synthesized
NLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 824 - protein, 157 aa, Artificial Sequence
  chemically synthesized
QGQSGQGNLCTEHSAALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 825 - protein, 146 aa, Artificial Sequence
  chemically synthesized
NLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 826 - protein, 153 aa, Artificial Sequence
  chemically synthesized
QGQSGQGNLCTEHSAALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 827 - protein, 150 aa, Artificial Sequence
  chemically synthesized
NLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 828 - protein, 157 aa, Artificial Sequence
  chemically synthesized
QGQSGQGNLCTEHSAALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 829 - protein, 141 aa, Artificial Sequence
  chemically synthesized
CTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 830 - protein, 148 aa, Artificial Sequence
  chemically synthesized
QGQSGQGCTEHSFALDCGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 831 - protein, 145 aa, Artificial Sequence
  chemically synthesized
CTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 832 - protein, 152 aa, Artificial Sequence
  chemically synthesized
QGQSGQGCTEHSFALDCGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 833 - protein, 141 aa, Artificial Sequence
  chemically synthesized
CTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 834 - protein, 148 aa, Artificial Sequence
  chemically synthesized
QGQSGQGCTEHSFALDCGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 835 - protein, 145 aa, Artificial Sequence
  chemically synthesized
CTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 836 - protein, 152 aa, Artificial Sequence
  chemically synthesized
QGQSGQGCTEHSFALDCGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 837 - protein, 146 aa, Artificial Sequence
  chemically synthesized
NLCTEHSAALDCRSYGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 838 - protein, 153 aa, Artificial Sequence
  chemically synthesized
QGQSGQGNLCTEHSAALDCRSYGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 839 - protein, 141 aa, Artificial Sequence
  chemically synthesized
CTEHSFALDCGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 840 - protein, 148 aa, Artificial Sequence
  chemically synthesized
QGQSGQGCTEHSFALDCGGGSSGGSGGSGGSGGGSGGGSGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 841 - protein, 146 aa, Artificial Sequence
  chemically synthesized
NLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 842 - protein, 153 aa, Artificial Sequence
  chemically synthesized
QGQSGQGNLCTEHSAALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 843 - protein, 146 aa, Artificial Sequence
  chemically synthesized
NLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 844 - protein, 153 aa, Artificial Sequence
  chemically synthesized
QGQSGQGNLCTEHSAALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 845 - protein, 146 aa, Artificial Sequence
  chemically synthesized
NLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 846 - protein, 153 aa, Artificial Sequence
  chemically synthesized
QGQSGQGNLCTEHSAALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 847 - protein, 150 aa, Artificial Sequence
  chemically synthesized
NLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 848 - protein, 157 aa, Artificial Sequence
  chemically synthesized
QGQSGQGNLCTEHSAALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 849 - protein, 150 aa, Artificial Sequence
  chemically synthesized
NLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 850 - protein, 157 aa, Artificial Sequence
  chemically synthesized
QGQSGQGNLCTEHSAALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 851 - protein, 150 aa, Artificial Sequence
  chemically synthesized
NLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 852 - protein, 157 aa, Artificial Sequence
  chemically synthesized
QGQSGQGNLCTEHSAALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 853 - protein, 141 aa, Artificial Sequence
  chemically synthesized
CTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 854 - protein, 148 aa, Artificial Sequence
  chemically synthesized
QGQSGQGCTEHSFALDCGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 855 - protein, 141 aa, Artificial Sequence
  chemically synthesized
CTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 856 - protein, 148 aa, Artificial Sequence
  chemically synthesized
QGQSGQGCTEHSFALDCGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 857 - protein, 141 aa, Artificial Sequence
  chemically synthesized
CTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 858 - protein, 148 aa, Artificial Sequence
  chemically synthesized
QGQSGQGCTEHSFALDCGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 859 - protein, 145 aa, Artificial Sequence
  chemically synthesized
CTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 860 - protein, 152 aa, Artificial Sequence
  chemically synthesized
QGQSGQGCTEHSFALDCGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 861 - protein, 145 aa, Artificial Sequence
  chemically synthesized
CTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 862 - protein, 152 aa, Artificial Sequence
  chemically synthesized
QGQSGQGCTEHSFALDCGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 863 - protein, 145 aa, Artificial Sequence
  chemically synthesized
CTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 864 - protein, 152 aa, Artificial Sequence
  chemically synthesized
QGQSGQGCTEHSFALDCGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 865 - protein, 146 aa, Artificial Sequence
  chemically synthesized
QFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 866 - protein, 153 aa, Artificial Sequence
  chemically synthesized
QGQSGQGQFCPWSYYLIGDCDIGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 867 - protein, 150 aa, Artificial Sequence
  chemically synthesized
QFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 868 - protein, 157 aa, Artificial Sequence
  chemically synthesized
QGQSGQGQFCPWSYYLIGDCDIGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 869 - protein, 146 aa, Artificial Sequence
  chemically synthesized
QFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 870 - protein, 153 aa, Artificial Sequence
  chemically synthesized
QGQSGQGQFCPWSYYLIGDCDIGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 871 - protein, 150 aa, Artificial Sequence
  chemically synthesized
QFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 872 - protein, 157 aa, Artificial Sequence
  chemically synthesized
QGQSGQGQFCPWSYYLIGDCDIGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 873 - protein, 146 aa, Artificial Sequence
  chemically synthesized
QFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 874 - protein, 153 aa, Artificial Sequence
  chemically synthesized
QGQSGQGQFCPWSYYLIGDCDIGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 875 - protein, 150 aa, Artificial Sequence
  chemically synthesized
QFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 876 - protein, 157 aa, Artificial Sequence
  chemically synthesized
QGQSGQGQFCPWSYYLIGDCDIGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 877 - protein, 146 aa, Artificial Sequence
  chemically synthesized
QFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 878 - protein, 153 aa, Artificial Sequence
  chemically synthesized
QGQSGQGQFCPWSYYLIGDCDIGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 879 - protein, 150 aa, Artificial Sequence
  chemically synthesized
QFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 880 - protein, 157 aa, Artificial Sequence
  chemically synthesized
QGQSGQGQFCPWSYYLIGDCDIGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 881 - protein, 146 aa, Artificial Sequence
  chemically synthesized
QFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 882 - protein, 153 aa, Artificial Sequence
  chemically synthesized
QGQSGQGQFCPWSYYLIGDCDIGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 883 - protein, 150 aa, Artificial Sequence
  chemically synthesized
QFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 884 - protein, 157 aa, Artificial Sequence
  chemically synthesized
QGQSGQGQFCPWSYYLIGDCDIGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 885 - protein, 146 aa, Artificial Sequence
  chemically synthesized
NLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 886 - protein, 153 aa, Artificial Sequence
  chemically synthesized
QGQSGQGNLCTEHSFALDCRSYGGGSSGGSISSGLLSGRSDNHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 887 - protein, 150 aa, Artificial Sequence
  chemically synthesized
NLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 888 - protein, 157 aa, Artificial Sequence
  chemically synthesized
QGQSGQGNLCTEHSFALDCRSYGGGSSGGSAVGLLAPPGGLSGRSDNHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 889 - protein, 146 aa, Artificial Sequence
  chemically synthesized
NLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 890 - protein, 153 aa, Artificial Sequence
  chemically synthesized
QGQSGQGNLCTEHSFALDCRSYGGGSSGGSISSGLLSGRSDIHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 891 - protein, 150 aa, Artificial Sequence
  chemically synthesized
NLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 892 - protein, 157 aa, Artificial Sequence
  chemically synthesized
QGQSGQGNLCTEHSFALDCRSYGGGSSGGSAVGLLAPPGGLSGRSDIHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 893 - protein, 146 aa, Artificial Sequence
  chemically synthesized
NLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 894 - protein, 153 aa, Artificial Sequence
  chemically synthesized
QGQSGQGNLCTEHSFALDCRSYGGGSSGGSISSGLLSGRSDQHGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 895 - protein, 150 aa, Artificial Sequence
  chemically synthesized
NLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 896 - protein, 157 aa, Artificial Sequence
  chemically synthesized
QGQSGQGNLCTEHSFALDCRSYGGGSSGGSAVGLLAPPGGLSGRSDQHGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 897 - protein, 146 aa, Artificial Sequence
  chemically synthesized
NLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 898 - protein, 153 aa, Artificial Sequence
  chemically synthesized
QGQSGQGNLCTEHSFALDCRSYGGGSSGGSISSGLLSGRSDNPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 899 - protein, 150 aa, Artificial Sequence
  chemically synthesized
NLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 900 - protein, 157 aa, Artificial Sequence
  chemically synthesized
QGQSGQGNLCTEHSFALDCRSYGGGSSGGSAVGLLAPPGGLSGRSDNPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 901 - protein, 146 aa, Artificial Sequence
  chemically synthesized
NLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 902 - protein, 153 aa, Artificial Sequence
  chemically synthesized
QGQSGQGNLCTEHSFALDCRSYGGGSSGGSISSGLLSGRSANPGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 903 - protein, 150 aa, Artificial Sequence
  chemically synthesized
NLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 904 - protein, 157 aa, Artificial Sequence
  chemically synthesized
QGQSGQGNLCTEHSFALDCRSYGGGSSGGSAVGLLAPPGGLSGRSANPGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 905 - protein, 146 aa, Artificial Sequence
  chemically synthesized
NLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 906 - protein, 153 aa, Artificial Sequence
  chemically synthesized
QGQSGQGNLCTEHSFALDCRSYGGGSSGGSISSGLLSGRSANIGGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 907 - protein, 150 aa, Artificial Sequence
  chemically synthesized
NLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 908 - protein, 157 aa, Artificial Sequence
  chemically synthesized
QGQSGQGNLCTEHSFALDCRSYGGGSSGGSAVGLLAPPGGLSGRSANIGGSDIQMTQSPSSLSASVGDRVTITCSASSSVYYMYWFQQKPGKAPKLWIYSTSNLASGVPSRFSGSGSGTDYTLTISSMQPEDFATYYCQQRRNYPYTFGQGTKLEIK

SEQ ID NO: 909 - protein, 14 aa, Artificial Sequence
  chemically synthesized
GSSTGAVTSGHYPY

SEQ ID NO: 910 - protein, 7 aa, Artificial Sequence
  chemically synthesized
DTTEKHS

SEQ ID NO: 911 - protein, 10 aa, Artificial Sequence
  chemically synthesized
LLSSGDGRAV

SEQ ID NO: 912 - protein, 5 aa, Artificial Sequence
  chemically synthesized
NYGMS

SEQ ID NO: 913 - protein, 17 aa, Artificial Sequence
  chemically synthesized
WISAYNGNTNYGEKLQG

SEQ ID NO: 914 - protein, 13 aa, Artificial Sequence
  chemically synthesized
DDYYGSGVDAFDI

SEQ ID NO: 915 - protein, 11 aa, Artificial Sequence
  chemically synthesized
GGNKIGSKSVH

SEQ ID NO: 916 - protein, 7 aa, Artificial Sequence
  chemically synthesized
YDRDRPS

SEQ ID NO: 917 - protein, 10 aa, Artificial Sequence
  chemically synthesized
QVWDSSSDVV

SEQ ID NO: 918 - protein, 5 aa, Artificial Sequence
  chemically synthesized
SYGMH

SEQ ID NO: 919 - protein, 17 aa, Artificial Sequence
  chemically synthesized
VISFDGSSKYYADSVKG

SEQ ID NO: 920 - protein, 14 aa, Artificial Sequence
  chemically synthesized
DSNFWSGYYSPVDV

SEQ ID NO: 921 - protein, 13 aa, Artificial Sequence
  chemically synthesized
TRSSGSIASNSVQ

SEQ ID NO: 922 - protein, 8 aa, Artificial Sequence
  chemically synthesized
YEDTQRPS

SEQ ID NO: 923 - protein, 10 aa, Artificial Sequence
  chemically synthesized
QSYDSAYHWV

SEQ ID NO: 924 - protein, 5 aa, Artificial Sequence
  chemically synthesized
SYWLS

SEQ ID NO: 925 - protein, 17 aa, Artificial Sequence
  chemically synthesized
KIDPSDSYTQYSPSFEG

SEQ ID NO: 926 - protein, 8 aa, Artificial Sequence
  chemically synthesized
HGYDAFHV

SEQ ID NO: 927 - protein, 13 aa, Artificial Sequence
  chemically synthesized
SGSSSNIGNNAVN

SEQ ID NO: 928 - protein, 7 aa, Artificial Sequence
  chemically synthesized
YDDLLPS

SEQ ID NO: 929 - protein, 11 aa, Artificial Sequence
  chemically synthesized
AAWDDSLNGWV

SEQ ID NO: 930 - protein, 5 aa, Artificial Sequence
  chemically synthesized
DYAMH

SEQ ID NO: 931 - protein, 17 aa, Artificial Sequence
  chemically synthesized
GISWNSGSIGYADSVKG

SEQ ID NO: 932 - protein, 13 aa, Artificial Sequence
  chemically synthesized
DQHREFYYYGMDV

SEQ ID NO: 933 - protein, 5 aa, Artificial Sequence
  chemically synthesized
SYWIG

SEQ ID NO: 934 - protein, 17 aa, Artificial Sequence
  chemically synthesized
IIYPGDSDTRYSPSFQG

SEQ ID NO: 935 - protein, 13 aa, Artificial Sequence
  chemically synthesized
QGTNWGVGDAFDI

SEQ ID NO: 936 - protein, 7 aa, Artificial Sequence
  chemically synthesized
DDSDRPS

SEQ ID NO: 937 - protein, 11 aa, Artificial Sequence
  chemically synthesized
QVWDISSDHVV

SEQ ID NO: 938 - protein, 16 aa, Artificial Sequence
  chemically synthesized
DRYYYGSGSYYDAFDI

SEQ ID NO: 939 - protein, 11 aa, Artificial Sequence
  chemically synthesized
NSRDSSGNHVV

SEQ ID NO: 940 - protein, 12 aa, Artificial Sequence
  chemically synthesized
VDPGDRGWYFDL

SEQ ID NO: 941 - protein, 13 aa, Artificial Sequence
  chemically synthesized
SGSSSNIGSNTVN

SEQ ID NO: 942 - protein, 7 aa, Artificial Sequence
  chemically synthesized
SNNQRPS

SEQ ID NO: 943 - protein, 7 aa, Artificial Sequence
  chemically synthesized
SSPYYWG

SEQ ID NO: 944 - protein, 16 aa, Artificial Sequence
  chemically synthesized
SVYYSGNTYYNPSLTR

SEQ ID NO: 945 - protein, 11 aa, Artificial Sequence
  chemically synthesized
HSWGINDAFDV

SEQ ID NO: 946 - protein, 13 aa, Artificial Sequence
  chemically synthesized
SGSSSNIGNNYVS

SEQ ID NO: 947 - protein, 7 aa, Artificial Sequence
  chemically synthesized
DNNKRPS

SEQ ID NO: 948 - protein, 11 aa, Artificial Sequence
  chemically synthesized
GTWDSSLSVWV

SEQ ID NO: 949 - protein, 17 aa, Artificial Sequence
  chemically synthesized
GISWNSGSIDYADSVKG

SEQ ID NO: 950 - protein, 10 aa, Artificial Sequence
  chemically synthesized
ENLAVAGLDY

SEQ ID NO: 951 - protein, 11 aa, Artificial Sequence
  chemically synthesized
QGDSLRGYYAS

SEQ ID NO: 952 - protein, 7 aa, Artificial Sequence
  chemically synthesized
DKNTRPS

SEQ ID NO: 953 - protein, 11 aa, Artificial Sequence
  chemically synthesized
QSRDNSGEMVV

SEQ ID NO: 954 - protein, 5 aa, Artificial Sequence
  chemically synthesized
ELSMH

SEQ ID NO: 955 - protein, 17 aa, Artificial Sequence
  chemically synthesized
GFDPEDGETIYAQKFQG

SEQ ID NO: 956 - protein, 15 aa, Artificial Sequence
  chemically synthesized
DAYYGSGSPRDAFDI

SEQ ID NO: 957 - protein, 11 aa, Artificial Sequence
  chemically synthesized
GGDNVGGKSLH

SEQ ID NO: 958 - protein, 7 aa, Artificial Sequence
  chemically synthesized
DDRDRPS

SEQ ID NO: 959 - protein, 11 aa, Artificial Sequence
  chemically synthesized
QVWDDISRLVI

SEQ ID NO: 960 - protein, 5 aa, Artificial Sequence
  chemically synthesized
SYYIH

SEQ ID NO: 961 - protein, 17 aa, Artificial Sequence
  chemically synthesized
IINPRGGGTDFAQKFQG

SEQ ID NO: 962 - protein, 15 aa, Artificial Sequence
  chemically synthesized
GDCTNGVCYSGGLDV

SEQ ID NO: 963 - protein, 7 aa, Artificial Sequence
  chemically synthesized
DNDKRPS

SEQ ID NO: 964 - protein, 10 aa, Artificial Sequence
  chemically synthesized
GTWDNSLSGV

SEQ ID NO: 965 - protein, 13 aa, Artificial Sequence
  chemically synthesized
DVDLWFGEYYFDY

SEQ ID NO: 966 - protein, 12 aa, Artificial Sequence
  chemically synthesized
GTWDSSLSAPYV

SEQ ID NO: 967 - protein, 5 aa, Artificial Sequence
  chemically synthesized
DYAMY

SEQ ID NO: 968 - protein, 17 aa, Artificial Sequence
  chemically synthesized
GINWNSAIIGYADSVKG

SEQ ID NO: 969 - protein, 11 aa, Artificial Sequence
  chemically synthesized
EALYYSAFFDS

SEQ ID NO: 970 - protein, 11 aa, Artificial Sequence
  chemically synthesized
GTWDSSLSAWV

SEQ ID NO: 971 - protein, 17 aa, Artificial Sequence
  chemically synthesized
GINWNGGSTDYADSVEG

SEQ ID NO: 972 - protein, 11 aa, Artificial Sequence
  chemically synthesized
DYADLGSGSDY

SEQ ID NO: 973 - protein, 13 aa, Artificial Sequence
  chemically synthesized
SGSRSNIGSNYVH

SEQ ID NO: 974 - protein, 7 aa, Artificial Sequence
  chemically synthesized
RNDQRPS

SEQ ID NO: 975 - protein, 11 aa, Artificial Sequence
  chemically synthesized
ASWDDKMSGRL

SEQ ID NO: 976 - protein, 5 aa, Artificial Sequence
  chemically synthesized
SYEMN

SEQ ID NO: 977 - protein, 17 aa, Artificial Sequence
  chemically synthesized
YISSSGSTIYYADSVKG

SEQ ID NO: 978 - protein, 17 aa, Artificial Sequence
  chemically synthesized
HSNYDILTGYSTDAFDI

SEQ ID NO: 979 - protein, 14 aa, Artificial Sequence
  chemically synthesized
TGTSSDIGFYDSVS

SEQ ID NO: 980 - protein, 7 aa, Artificial Sequence
  chemically synthesized
DVSNRPS

SEQ ID NO: 981 - protein, 11 aa, Artificial Sequence
  chemically synthesized
TSNTKTNTLYV

SEQ ID NO: 982 - protein, 7 aa, Artificial Sequence
  chemically synthesized
RGNYWWT

SEQ ID NO: 983 - protein, 16 aa, Artificial Sequence
  chemically synthesized
SVHYSGSTNYNPSLKS

SEQ ID NO: 984 - protein, 11 aa, Artificial Sequence
  chemically synthesized
DSDYGDYYFDY

SEQ ID NO: 985 - protein, 107 aa, Artificial Sequence
  chemically synthesized
DIQMTQSPASLSASLEEIVTITCQASQDIGNWLAWYQQKPGKSPQLLIYGATSLADGVPSRFSGSRSGTQFSLKISRVQVEDIGIYYCLQAYNTPWTFGGGTKLELK

SEQ ID NO: 986 - protein, 107 aa, Artificial Sequence
  chemically synthesized
DIQMTQSPASLSASLEEIVTITCQASQDIGNWLAWYQQKPGKSPQLLIYGATSLADGVPSRFSGSRSGTQFSLKISRVQVEDIGIYYCLQAYNTPWTFGGGTKVEIK

SEQ ID NO: 987 - protein, 108 aa, Artificial Sequence
  chemically synthesized
KIVMTQSPKSMSMSVGERVTLNCRASESVDTYVSWYQQKPEQSPELLIYGASNRYTGVPDRFTGSGSATDFTLTISSVQAEDLADYYCGQTYNYPLTFGAGTKLELKR

SEQ ID NO: 988 - protein, 119 aa, Artificial Sequence
  chemically synthesized
EVQLQQSGAVLVKPGASVKLSCPASGFNIKDTYIHWVIQRPEQGLEWIGRIDPANGDTKCDPKFQVKATITADTSSNTAYLQLSSLTSEDTAVYFCVRDYLYPYYFDFWGQGTTLTVSS

SEQ ID NO: 989 - protein, 122 aa, Artificial Sequence
  chemically synthesized
QSMEESGGRLVTPGTPLTLTCTVSGFSLSSYAMSWVRQAPGKGLEWIGYIWSGGSTDYASWAKGRFTISKTSTTVDLKITSPTTEDTATYFCARRYGTSYPDYGDANGFDPWGPGTLVTVSS

SEQ ID NO: 990 - protein, 111 aa, Artificial Sequence
  chemically synthesized
AYDMTQTPASVEVAVGGTVTIKCQASQSISSYLSWYQQKPGQRPKLLIYRASTLASGVSSRFKGSGSGTQFTLTISGVECADAATYYCQQCYSSSNVDNTFGGGTEVVVKR

SEQ ID NO: 991 - protein, 14 aa, Artificial Sequence
  chemically synthesized
DSAFWSGYYSPVDV

SEQ ID NO: 992 - protein, 14 aa, Artificial Sequence
  chemically synthesized
DSNLWSGYYSPVDV

SEQ ID NO: 993 - protein, 14 aa, Artificial Sequence
  chemically synthesized
DSNFWGGYYSPVDV

SEQ ID NO: 994 - protein, 14 aa, Artificial Sequence
  chemically synthesized
DSALWGGYYSPVDV

SEQ ID NO: 995 - protein, 14 aa, Artificial Sequence
  chemically synthesized
DGNLWGGYYSPVDV

SEQ ID NO: 996 - protein, 14 aa, Artificial Sequence
  chemically synthesized
DGAFWGGYYSPVDV

SEQ ID NO: 997 - protein, 14 aa, Artificial Sequence
  chemically synthesized
DGALWSGYYSPVDV

SEQ ID NO: 998 - protein, 14 aa, Artificial Sequence
  chemically synthesized
DGALWGGYYSPVDV

SEQ ID NO: 999 - protein, 122 aa, Artificial Sequence
  chemically synthesized
DVQLVESGGGLVQPGGSLRLSCAASGFPFKSYGMQWVRQAPGKGLEWVAVISFDGSSRYYADSVKGRFTISRDNSKNTLYLQMNSLRAEDTAVYYCARDGALWGGYYSPVDVWGQGTLVTVS

SEQ ID NO: 1000 - protein, 123 aa, Artificial Sequence
  chemically synthesized
DVQLVESGGGLVQPGGSLRLSCAASGFPFKSYAMHWVRQAPGKGLEWVAVISYDGSNKYYADSVKGRFTISRDNSKNTLYLQMNSLRAEDTAVYYCARDGALWGGYYSPVDVWGQGTLVTVSS

SEQ ID NO: 1001 - protein, 123 aa, Artificial Sequence
  chemically synthesized
DVQLVESGGGLVQPGGSLRLSCAASGFPFKSYAMHWVRQAPGKGLEWVAVISFDGSNKYYADSVKGRFTISRDNSKNTLYLQMNSLRAEDTAVYYCARDGALWGGYYSPVDVWGQGTLVTVSS

SEQ ID NO: 1002 - protein, 123 aa, Artificial Sequence
  chemically synthesized
DVQLVESGGGLVQPGGSLRLSCAASGFPFKSYAMHWVRQAPGKGLEWVAVISFDGGSRYYADSVKGRFTISRDNSKNTLYLQMNSLRAEDTAVYYCARDGALWGGYYSPVDVWGQGTLVTVSS

SEQ ID NO: 1003 - protein, 123 aa, Artificial Sequence
  chemically synthesized
DVQLVESGGGLVQPGGSLRLSCAASGFPFKSYGMQWVRQAPGKGLEWVAVISFDGGSRYYADSVKGRFTISRDNSKNTLYLQMNSLRAEDTAVYYCARDGALWGGYYSPVDVWGQGTLVTVSS

SEQ ID NO: 1004 - protein, 123 aa, Artificial Sequence
  chemically synthesized
DVQLVESGGGLVQPGGSLRLSCAASGFTFSSYAMQWVRQAPGKGLEWVAVISFDGGSRYYADSVKGRFTISRDNSKNTLYLQMNSLRAEDTAVYYCARDGALWGGYYSPVDVWGQGTLVTVSS

SEQ ID NO: 1005 - protein, 123 aa, Artificial Sequence
  chemically synthesized
DVQLVESGGGLVQPGGSLRLSCAASGFTFSSYGMQWVRQAPGKGLEWVAVISFDGGSRYYADSVKGRFTISRDNSKNTLYLQMNSLRAEDTAVYYCARDGALWGGYYSPVDVWGQGTLVTVSS

SEQ ID NO: 1006 - protein, 123 aa, Artificial Sequence
  chemically synthesized
DVQLVESGGGLVQPGGSLRLSCAASGFTFSSYAMQWVRQAPGKGLEWVSVISFDGGNRYYADSVKGRFTISRDNSKNTLYLQMNSLRAEDTAVYYCARDGALWGGYYSPVDVWGQGTLVTVSS

SEQ ID NO: 1007 - protein, 122 aa, Artificial Sequence
  chemically synthesized
DVQLVESGGGLVQPGGSLRLSCAASGFTFSSYAMQWVRQAPGKGLEWVSIVSFDGGNRYYADSIGRFTISRDNSKNTLYLQMNSLRAEDTAVYYCARDGALWGGYYSPIDVWGQGTLVTVSS

SEQ ID NO: 1008 - protein, 111 aa, Artificial Sequence
  chemically synthesized
DFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNHWVFGGGTKLAVL

SEQ ID NO: 1009 - protein, 111 aa, Artificial Sequence
  chemically synthesized
DFMLTQPQSVSESPGKTVTISCTRSSGSIASNYVQWYQQRPGSSPTTVIYEDNQRPSGVPDRFSGSIDSSSNSASLTISGLKTEDEADYYCQSYDSSNQWVFGGGTKLAVL

SEQ ID NO: 1010 - protein, 101 aa, Artificial Sequence
  chemically synthesized
  MISC_FEATURE (3)..(3): X is any amino acid
  MISC_FEATURE (32)..(32): X is any amino acid
  MISC_FEATURE (41)..(41): X is any amino acid
  MISC_FEATURE (69)..(70): X is any amino acid
  MISC_FEATURE (101)..(101): X is any amino acid
QSXLTQPPSVSGSPGQSVTISCTGSSSNIGSXNYVSWYQQXPGTAPKLMIYENNKRPSGVPDRFSGSKXXSGNTASLTISGLQAEDEADYYCSSWDSSLSX

SEQ ID NO: 1011 - protein, 112 aa, Artificial Sequence
  chemically synthesized
DSALTQPPSVSGSPGQSVTISCTGSSSNIIASNSVQWYQQLPGTAPKTVIYEDTQRPSGVPDRFSGSKDSSGNTASLTISGLQAEDEADYYCQSYDSAYHWVFGGGTKLAVL

SEQ ID NO: 1012 - protein, 112 aa, Artificial Sequence
  chemically synthesized
DSALTQPPSVSGSPGQSVTISCTGSSSNIIASNSVQWYQQLPGTAPKTVIYENTQRPSGVPDRFSGSKDSSGNTASLTISGLQAEDEADYYCSSYDSAYHWVFGGGTKLAVL

SEQ ID NO: 1013 - protein, 111 aa, Artificial Sequence
  chemically synthesized
DFMLTQPHSVSESPGKTVIISCTRSDGTIAGYYVQWYQQRPGRAPTTVIFEDTQRPSGVPDRFSGSIDRSSNSASLTISGLQTEDEADYYCQSYDRDHWVFGGGTKLTVLG

SEQ ID NO: 1014 - protein, 111 aa, Artificial Sequence
  chemically synthesized
DFMLTQPHSVSESPGKTVIISCTRSDGTIAGYYVQWYQQRPGRAPTTVIFEDTQRPSGVPDRFSGSIDRSSNSASLTISGLQTEDEADYYCQSYDSRDHWVFGGGTKLTVL

SEQ ID NO: 1015 - protein, 111 aa, Artificial Sequence
  chemically synthesized
DFMLTQPQSVSESPGKTVIISCTRSTGTIASNSVQWYQQRPGRAPTTVIFDETQRPSGVPDRFSGSIDRSSNSASLTISGLQTEDEADYYCQSYDSRDQWVFGGGTKLTVL

SEQ ID NO: 1016 - protein, 107 aa, Artificial Sequence
  chemically synthesized
DIQMTQSPSSLSASVGDRVTITCRASQSISNYLAWYQQKPGKAPKLLIYAASSLESGVPSRFSGSGSGTDFTLTISSLQPEDFATYYCQQYNSLPWTFGQGTKVEIK

SEQ ID NO: 1017 - protein, 108 aa, Artificial Sequence
  chemically synthesized
DIQMTQSPSSLSASVGDRVTITCRASQIASNSVQWYQQKPGKAPKTVIYEDTQLESGVPSRFSGSGSGTDFTLTISSLQPEDFATYYCQSYDSAYHWVFGQGTKVEIK

SEQ ID NO: 1018 - protein, 95 aa, Artificial Sequence
  chemically synthesized
DIQMTQSPSTLSASVGDRVTITCRASQSISSWLAWYQQKPGKAPKLLIYDASSLESGVPSRFSGSGSGTEFTLTISSLQPDDFATYYCQQYNSYS

SEQ ID NO: 1019 - protein, 108 aa, Artificial Sequence
  chemically synthesized
DIQMTQSPSTLSASVGDRVTITCRASQIASNSVQWYQQKPGKAPKTVIYEDTQLESGVPSRFSGSGSGTEFTLTISSLQPDDFATYYCQSYDSAYHWVFGQGTKVEIK

SEQ ID NO: 1020 - protein, 108 aa, Artificial Sequence
  chemically synthesized
DIQMTQSPSTLSASVGDRVTITCRASQIASNSVQWYQQKPGKAPKTVIYEDTQLESGVPSRFSGSGSGTEFTLTISSLQPDDFATYYCQSYNSAYHWVFGQGTKVEIK

SEQ ID NO: 1021 - protein, 108 aa, Artificial Sequence
  chemically synthesized
DIQMTQSPSTLSASVGDRVTITCRASQIASNSVQWYQQKPGKAPKTVIYEDTQLESGVPSRFSGSGSGTEFTLTISSLQPDDFATYYCQSYNSAYQWVFGQGTKVEIK

SEQ ID NO: 1022 - protein, 107 aa, Artificial Sequence
  chemically synthesized
DIQMTQSPSSLSASVGDRVTITCRASQGIRNDLTWYQQKPGTAPKRLIYGATSLQSGVPSRFSGSGSGTEFTLTINSLQPEDFATYYCLQYSSFPWTFGQGTKVEVK

SEQ ID NO: 1023 - protein, 108 aa, Artificial Sequence
  chemically synthesized
DIQMTQSPSSLSASVGDRVTITCRASQIASNSVQWYQQKPGTAPKTVIYEDTQLQSGVPSRFSGSGSGTEFTLTINSLQPEDFATYYCQSYDSAYHWVFGQGTKVEIK

SEQ ID NO: 1024 - protein, 108 aa, Artificial Sequence
  chemically synthesized
DIQMTQSPSSLSASVGDRVTITCRASQIASNSVQWYQQKPGTAPKTVIYEDTQLQSGVPSRFSGSGSGTEFTLTINSLQPEDFATYYCQSYNSAYHWVFGQGTKVEIK

SEQ ID NO: 1025 - protein, 108 aa, Artificial Sequence
  chemically synthesized
DIQMTQSPSSLSASVGDRVTITCRASQIASNSVQWYQQKPGTAPKTVIYEDTQLQSGVPSRFSGSGSGTEFTLTINSLQPEDFATYYCQSYNSAYQWVFGQGTKVEIK

SEQ ID NO: 1026 - protein, 14 aa, Artificial Sequence
  chemically synthesized
DGNFWSGYYSPVDV

SEQ ID NO: 1027 - protein, 17 aa, Artificial Sequence
  chemically synthesized
VISYDGSSKYYADSVKG

SEQ ID NO: 1028 - protein, 6 aa, Artificial Sequence
  chemically synthesized
FSLSSY

SEQ ID NO: 1029 - protein, 14 aa, Artificial Sequence
  chemically synthesized
GTSYPDYGDANGFD

SEQ ID NO: 1030 - protein, 7 aa, Artificial Sequence
  chemically synthesized
SQSISSY

SEQ ID NO: 1031 - protein, 3 aa, Artificial Sequence
  chemically synthesized
RAS

SEQ ID NO: 1032 - protein, 9 aa, Artificial Sequence
  chemically synthesized
CYSSSNVDN

SEQ ID NO: 1033 - protein, 7 aa, Artificial Sequence
  chemically synthesized
GFNIKDT

SEQ ID NO: 1034 - protein, 8 aa, Artificial Sequence
  chemically synthesized
YLYPYYFD

SEQ ID NO: 1035 - protein, 7 aa, Artificial Sequence
  chemically synthesized
SESVDTY

SEQ ID NO: 1036 - protein, 6 aa, Artificial Sequence
  chemically synthesized
TYNYPL

SEQ ID NO: 1037 - protein, 6 aa, Artificial Sequence
  chemically synthesized
GGSGGS

What is claimed:

1. An isolated antibody or an antigen binding fragment thereof (AB) that specifically binds human CD71 and cynomolgus monkey CD71,
wherein the AB comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15).

2. The AB of claim 1, wherein the AB comprises a heavy chain variable region comprising an amino acid sequence selected from the group consisting of SEQ ID NOs: 3-5, and a light chain variable region comprising an amino acid sequence selected from the group consisting of SEQ ID NOs: 6-8.

3. An activatable antibody that, in an activated state, specifically binds to human CD71 and cynomolgus CD71 comprising:
an antibody or an antigen binding fragment thereof (AB) that specifically binds human CD71 and cynomolgus monkey CD71;
a masking moiety (MM) coupled to the AB that inhibits the binding of the AB to CD71 when the activatable antibody is in an uncleaved state; and
a cleavable moiety (CM) coupled to the AB, wherein the CM is a polypeptide that functions as a substrate for a protease,
wherein the AB comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15).

4. The activatable antibody of claim 3, wherein the MM has one or more of the characteristics selected from the group consisting of:
(i) the MM has a dissociation constant for binding to the AB that is greater than the dissociation constant of the AB to CD71;
(ii) the MM does not interfere or compete with the AB for binding to CD71 when the activatable antibody is in a cleaved state;
(iii) the MM is a polypeptide of no more than 40 amino acids in length;
(iv) the MM polypeptide sequence is different from that of human CD71;
(v) the MM polypeptide sequence is no more than 50% identical to any natural binding partner of the AB; and
(vi) the MM comprises an amino acid sequence selected from the group consisting of SEQ ID NOs: 16-295 and 297-314.

5. The activatable antibody of claim 3, wherein the CM has one or more of the characteristics selected from the group consisting of:
(i) the CM is a substrate for a protease that is active in diseased tissue; and
(ii) the CM comprises an amino acid sequence selected from the group consisting of SEQ ID NOs: 356-423, 680-698, 713, 714, and 789-808.

6. The activatable antibody of claim 3, wherein the antigen binding fragment thereof is selected from the group consisting of a Fab fragment, a F(ab')$_2$ fragment, a scFv, and a scAb.

7. The activatable antibody of claim 3, wherein
the AB comprises a heavy chain variable region comprising an amino acid sequence selected from the group consisting of SEQ ID NOs: 3-5, and a light chain variable region comprising an amino acid sequence selected from the group consisting of SEQ ID NOs: 6-8.

8. The activatable antibody of claim 3, wherein the AB is linked to the CM.

9. The activatable antibody of claim 3, wherein the AB is linked directly to the CM.

10. The activatable antibody of claim 3, wherein the AB is linked to the CM via a linking peptide.

11. The activatable antibody of claim 3, wherein the MM is linked to the CM such that the activatable antibody in an uncleaved state comprises the structural arrangement from N-terminus to C-terminus as follows: MM-CM-AB or AB-CM-MM.

12. The activatable antibody of claim 3, wherein the activatable antibody comprises a linking peptide between the MM and the CM, a linking peptide between the CM and the AB, or both a linking peptide between the MM and the CM and a linking peptide between the CM and the AB.

13. The activatable antibody of claim 3, wherein the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM.

14. The activatable antibody of claim 13, wherein the two linking peptides are not identical to each other.

15. The activatable antibody of claim 13, wherein each of LP1 and LP2 is a peptide of about 1 to 20 amino acids in length.

16. The activatable antibody of claim 3, wherein the activatable antibody has one or more of the characteristics selected from the group consisting of:

(a) the activatable antibody comprises the heavy chain sequence of SEQ ID NO: 325 or 699 and a light chain comprising an amino acid sequence selected from the group consisting of SEQ ID NOs: 327, 329, 331, 333, 335, 337, 650, 652, 654, 656, 658, 660, 670-673, 701-712, and 721-788;

(b) the activatable antibody comprises a combination of amino acid sequences, wherein the combination of amino acid sequences is selected from a single row in Table D, wherein for a given combination,
  (i) the heavy chain of the AB comprises the amino acid sequences of the VH CDR sequences corresponding to the given combination in the single row listed in Table D,
  (ii) the light chain of the AB comprises the amino acid sequences of the VL CDR sequences corresponding to the given combination in the single row listed in Table D,
  (iii) the MM comprises the amino acid sequence of the mask sequence (MM) corresponding to the given combination in the single row listed in Table D, and
  (iv) the CM comprises the amino acid sequence of the substrate sequence (CM) corresponding to the given combination in the single row listed in Table D;

(c) the activatable antibody comprises a combination of amino acid sequences, wherein for a given combination of amino acid sequences,
  (i) the heavy chain of the AB comprises the amino acid sequences of the VH sequence or VH CDR sequences selected from the group consisting of: the VH sequence or VH CDR sequences listed in the corresponding column of Table E,
  (ii) the light chain of the AB comprises the amino acid sequences of the VL sequence or VL CDR sequences selected from the group consisting of: the VL sequence or VL CDR sequences listed in the corresponding column of Table E,
  (iii) the MM comprises the amino acid sequence of the mask sequence (MM) selected from the group consisting of: the MM sequences listed in the corresponding column of Table E, and
  (iv) the CM comprises the amino acid sequence of the substrate sequence (CM) selected from the group consisting of: the CM sequences listed in the corresponding column of Table E; and (d) the activatable antibody comprises a heavy chain variable region comprising an amino acid sequence selected from the group consisting of SEQ ID NOs: 3-5, and a light chain variable region comprising an amino acid sequence selected from the group consisting of SEQ ID NOs: 6-8, 809-836, and 841-908.

17. An activatable antibody comprising an antibody or an antigen binding fragment thereof (AB) that specifically binds to human CD71 and cynomolgus CD71, a masking moiety (MM), and a cleavable moiety (CM),
  wherein the AB comprises the VH CDR1 sequence GYTFTSYWMH (SEQ ID NO: 9), the VH CDR2 sequence AIYPGNSETG (SEQ ID NO: 10), the VH CDR3 sequence ENWDPGFAF (SEQ ID NO: 11), the VL CDR1 sequence SASSSVYYMY (SEQ ID NO: 12) or CRASSSVYYMY (SEQ ID NO: 13), the VL CDR2 sequence STSNLAS (SEQ ID NO: 14), and the VL CDR3 sequence QQRRNYPYT (SEQ ID NO: 15); and
  wherein the activatable antibody has one or more of the following characteristics selected from the group consisting of:
    (i) the activatable antibody comprises a heavy chain sequence of SEQ ID NOS: 325 or 699; and a light chain comprising an amino acid sequence selected from the group consisting of SEQ ID NOS: 327, 329, 331, 333, 335, 337, 650, 652, 654, 656, 658, 660, 670-673, 701-712, and 721-788;
    (ii) the MM comprises an amino acid sequence selected from the group consisting of SEQ ID NOs: 16-295 and 297-314, and the CM comprises an amino acid sequence selected from the group consisting of SEQ ID NOs: 356-423, 680-698, 713, 714, and 789-808; and
    (iii) the activatable antibody comprises a heavy chain variable region comprising an amino acid sequence selected from the group consisting of SEQ ID NOs: 3-5, and a light chain variable region comprising an amino acid sequence selected from the group consisting of SEQ ID NOs: 6-8, 809-836, and 841-908.

18. A conjugated activatable antibody comprising the activatable antibody of claim 3 conjugated to an agent.

19. The conjugated activatable antibody of claim 18, wherein the agent has one or more of the characteristics selected from the group consisting of:
  (a) the agent is a toxin or fragment thereof;
  (b) the agent is a microtubule inhibitor;
  (c) the agent is a nucleic acid damaging agent;
  (d) the agent is a dolastatin or a derivative thereof;
  (e) the agent is an auristatin or a derivative thereof;
  (f) the agent is a maytansinoid or a derivative thereof;
  (g) the agent is a duocarmycin or a derivative thereof;
  (h) the agent is a calicheamicin or a derivative thereof;
  (i) the agent is a pyrrolobenzodiazepine or a derivative thereof;
  (j) the agent is auristatin E or a derivative thereof;
  (k) the agent is monomethyl auristatin E (MMAE);
  (l) the agent is monomethyl auristatin D (MMAD);
  (m) the agent is the maytansinoid DM1;
  (n) the agent is the maytansinoid DM4;
  (o) the agent is a detectable moiety; and
  (p) the agent is a diagnostic agent.

20. The conjugated activatable antibody of claim 18, wherein the agent is conjugated to the AB via a linker.

21. The conjugated activatable antibody of claim 20, wherein the linker with which the agent is conjugated to the AB comprises an SPDB moiety, a vc moiety, or a PEG2-vc moiety.

22. The conjugated activatable antibody of claim 18, wherein the agent is a toxin conjugated to the AB via a linker, and wherein the linker and the toxin conjugated to the AB comprise a moiety selected from the group consisting of: an SPDB-DM4 moiety, a vc-MMAD moiety, a vc-MMAE moiety, a vc-duocarmycin moiety, or a PEG2-vc-MMAD moiety.

23. The conjugated activatable antibody of claim 20, wherein the linker is a cleavable linker.

24. The conjugated activatable antibody of claim 20, wherein the linker is a non-cleavable linker.

25. A conjugated activatable antibody that, in an activated state, binds human CD71 and cynomolgus CD71 comprising:
  (a) an activatable antibody comprising:
    (i) an antibody or an antigen binding fragment thereof (AB) that specifically binds to human CD71 and cynomolgus CD71, wherein the AB specifically binds human CD71 and cynomolgus monkey CD71, wherein the AB comprises the VH CDR1 sequence GYTFTSYWMH (SEQ ID NO: 9), the VH CDR2 sequence AIYPGNSETG (SEQ ID NO: 10), the VH CDR3 sequence ENWDPGFAF (SEQ ID NO: 11), the VL CDR1 sequence SASSSVYYMY (SEQ ID NO: 12) or CRASSSVYYMY (SEQ ID NO: 13), the VL CDR2 sequence STSNLAS (SEQ ID NO: 14), and the VL CDR3 sequence QQRRNYPYT (SEQ ID NO: 15);
  (ii) a masking moiety (MM) coupled to the AB that inhibits the binding of the AB to CD71 when the activatable antibody is in an uncleaved state; and
  (iii) a cleavable moiety (CM) coupled to the AB, wherein the CM is a polypeptide that functions as a substrate for a protease; and
  (b) an agent conjugated to the AB.

26. The conjugated activatable antibody of claim 25, wherein the agent is selected from the group consisting of a dolastatin or a derivative thereof, an auristatin or a derivative thereof, a maytansinoid or a derivative thereof, a duocarmycin or a derivative thereof, a calicheamicin or a derivative thereof, a pyrrolobenzodiazepine or a derivative thereof, auristatin E, monomethyl auristatin F (MMAF), monomethyl auristatin E (MMAE), monomethyl auristatin D (MMAD), maytansinoid DM4, maytansinoid DM1, a duocarmycin, a calicheamicin, a pyrrolobenzodiazepine, and a pyrrolobenzodiazepine dimer.

27. The conjugated activatable antibody of claim 25, wherein the agent is conjugated to the AB via a linker.

28. The conjugated activatable antibody of claim 27, wherein the linker with which the agent is conjugated to the AB comprises an SPDB moiety, a vc moiety, or a PEG2-vc moiety.

29. The conjugated activatable antibody of claim 25, wherein the agent is a toxin conjugated to the AB via a linker, and wherein the linker and the toxin conjugated to the AB comprise a moiety selected from the group consisting of: an SPDB-DM4 moiety, a vc-MMAD moiety, a vc-MMAE moiety, a vc-duocarmycin moiety, or a PEG2-vc-MMAD moiety.

30. The conjugated activatable antibody of claim 25, wherein the activatable antibody has one or more of the characteristics selected from the group consisting of:
  (i) the activatable antibody comprises a heavy chain variable region comprising an amino acid sequence selected from the group consisting of SEQ ID NOs: 3-5, and a light chain variable region comprising an amino acid sequence selected from the group consisting of SEQ ID NOs: 6-8, 809-836, and 841-908; and
  (ii) the activatable antibody comprises a heavy chain comprising the amino acid sequence of SEQ ID NOS: 325 or 699, and a light chain comprising an amino acid sequence selected from the group consisting of SEQ ID NOS: 327, 329, 331, 333, 335, 337, 650, 652, 654, 656, 658, 660, 670-673, 701-712, and 721-788.

31. The conjugated activatable antibody of claim 25, wherein the MM comprises an amino acid sequence selected from the group consisting of SEQ ID NOs: 16-295 and 297-314.

32. The conjugated activatable antibody of claim 25, wherein the CM comprises an amino acid sequence selected from the group consisting of SEQ ID NOs: 356-423, 680-698, 713, 714, and 789-808.

33. The conjugated activatable antibody of claim 25, wherein the activatable antibody has one or more of the following characteristics selected from the group consisting of:
  (i) the activatable antibody comprises a combination of amino acid sequences, wherein the combination of amino acid sequences is selected from a single row in Table D, wherein for a given combination,
    (a) the heavy chain of the AB comprises the amino acid sequences of the VH CDR sequences corresponding to the given combination in the single row listed in Table D,
    (b) the light chain of the AB comprises the amino acid sequences of the VL CDR sequences corresponding to the given combination in the single row listed in Table D,
    (c) the MM comprises the amino acid sequence of the mask sequence (MM) corresponding to the given combination in the single row listed in Table D, and
    (d) the CM comprises the amino acid sequence of the substrate sequence (CM) corresponding to the given combination in the single row listed in Table D; and
  (ii) the activatable antibody comprises a combination of amino acid sequences, wherein for a given combination of amino acid sequences,
    (a) the heavy chain of the AB comprises the amino acid sequences of the VH sequence or VH CDR sequences selected from the group consisting of: the VH sequence or VH CDR sequences listed in the corresponding column of Table E,
    (b) the light chain of the AB comprises the amino acid sequences of the VL sequence or VL CDR sequences selected from the group consisting of: the VL sequence or VL CDR sequences listed in the corresponding column of Table E,
    (c) the MM comprises the amino acid sequence of the mask sequence (MM) selected from the group consisting of: the MM sequences listed in the corresponding column of Table E, and
    (d) the CM comprises the amino acid sequence of the substrate sequence (CM) selected from the group consisting of: the CM sequences listed in the corresponding column of Table E.

34. A conjugated antibody comprising:
  (a) an antibody or an antigen binding fragment thereof (AB) that specifically binds to human CD71 and cynomolgus CD71, wherein the AB comprises:
    (i) the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15), or
    (ii) a heavy chain variable region comprising an amino acid sequence selected from the group consisting of SEQ ID NOs: 3-5, and a light chain variable region comprising an amino acid sequence selected from the group consisting of SEQ ID NOs: 6-8; and
  (b) an agent conjugated to the AB, wherein the agent is selected from the group consisting of auristatin E, monomethyl auristatin F (MMAF), monomethyl auristatin E (MMAE), monomethyl auristatin D (MMAD), maytansinoid DM4, maytansinoid DM1, a calicheamicin, a pyrrolobenzodiazepine, a pyrrolobenzodiazepine dimer, and a duocarmycin.

35. A conjugated activatable antibody that, in an activated state, specifically binds to human CD71 and cynomolgus CD71, comprising:
  (a) an activatable antibody comprising:
    (i) an antibody or an antigen binding fragment thereof (AB) that specifically binds human CD71 and cynomolgus monkey CD71, wherein the AB comprises the VH CDR1 sequence GYTFTSYWMH (SEQ ID NO: 9); the VH CDR2 sequence AIYPGNSETG (SEQ ID NO: 10); the VH CDR3 sequence ENWD-PGFAF (SEQ ID NO: 11); the VL CDR1 sequence SASSSVYYMY (SEQ ID NO: 12) or CRASSS-VYYMY (SEQ ID NO: 13); the VL CDR2 sequence STSNLAS (SEQ ID NO: 14); and the VL CDR3 sequence QQRRNYPYT (SEQ ID NO: 15);
 (ii) a masking moiety (MM) coupled to the AB that inhibits the binding of the AB to CD71 when the activatable antibody is in an uncleaved state;
 (iii) a cleavable moiety (CM) coupled to the AB, wherein the CM is a polypeptide that functions as a substrate for a protease; and (b) an agent conjugated to the AB, wherein the activatable antibody comprises:

(i) a heavy chain variable region comprising an amino acid sequence selected from the group consisting of SEQ ID NOs: 3-5, and a light chain variable region comprising an amino acid sequence selected from the group consisting of SEQ ID NOs: 6-8, 809-836, and 841-908, or (ii) a heavy chain comprising the amino acid sequence of SEQ ID NOS: 325 or 699, and a light chain comprising an amino acid sequence selected from the group consisting of SEQ ID NOS: 327, 329, 331, 333, 335, 337, 650, 652, 654, 656, 658, 660, 670-673, 701-712, and 721-788; and wherein the agent is selected from the group consisting of auristatin E, monomethyl auristatin F (MMAF), monomethyl auristatin E (MMAE), monomethyl auristatin D (MMAD), maytansinoid DM4, maytansinoid DM1, a calicheamicin, a pyrrolobenzodiazepine, a pyrrolobenzodiazepine dimer, and a duocarmycin.

36. The conjugated activatable antibody of claim 35, wherein the MM comprises an amino acid sequence selected from the group consisting of SEQ ID NOs: 16-295 and 297-314.

37. The conjugated activatable antibody of claim 35, wherein the CM comprises an amino acid sequence selected from the group consisting of SEQ ID NOs: 356-423, 680-698, 713, 714, and 789-808.

38. The conjugated activatable antibody of claim 35, wherein the agent is conjugated to the AB via a linker, and wherein the linker to which the agent is conjugated to the AB comprises an SPDB moiety, a vc moiety, or a PEG2-vc moiety.

39. The conjugated activatable antibody of claim 35, wherein the agent is a toxin conjugated to the AB via a linker, and wherein the linker and the toxin conjugated to the AB comprise a moiety selected from the group consisting of: an SPDB-DM4 moiety, a vc-MMAD moiety, a vc-MMAE moiety, a vc-duocarmycin moiety, or a PEG2-vc-MMAD moiety.

40. A conjugated activatable antibody or conjugated antibody comprising:

an antibody or antigen binding fragment thereof (AB) that, in an activated state, binds human CD71 and cynomolgus CD71; and a toxin conjugated to the AB via a linker, wherein the conjugated activatable antibody or the conjugated antibody comprises amino acid sequences, a linker, and a toxin selected from a single row in Table F, wherein for the given combination:

(a) the AB comprises a heavy chain comprising the amino acid sequence of the heavy chain sequence or heavy chain variable domain sequence corresponding to the given combination in the single row listed in Table F, (b) the AB comprises a light chain comprising the amino acid sequence of the light chain sequence or light chain variable domain sequence corresponding to the given combination in the single row listed in Table F, and (c) the linker and the toxin comprise the linker and the toxin corresponding to the given combination in the single row listed in Table F.

41. A pharmaceutical composition comprising the activatable antibody of claim 3; and a carrier.

42. The pharmaceutical composition of claim 41 comprising an additional agent.

43. The pharmaceutical composition of claim 42, wherein the additional agent is a therapeutic agent.

44. A pharmaceutical composition comprising the conjugated activatable antibody of claim 18; and a carrier.

45. The pharmaceutical composition of claim 44 comprising an additional agent.

46. The activatable antibody of claim 3, wherein the MM is linked to the CM.

47. The activatable antibody of claim 3, wherein the MM is linked directly to the CM.

48. The activatable antibody of claim 3, wherein the MM is linked to the CM via a linking peptide.

49. A conjugated activatable antibody that, in an activated state, specifically binds to human CD71 and cynomolgus CD71 comprising:

an antibody or an antigen binding fragment thereof (AB) that specifically binds to human CD71 and cynomolgus monkey CD71;

a masking moiety (MM) coupled to the AB that inhibits the binding of the AB to CD71when the activatable antibody is in an uncleaved state;

a cleavable moiety (CM) coupled to the AB, wherein the CM is a polypeptide that functions as a substrate for a protease; and an agent conjugated to the AB via a linker, wherein the AB comprises the VH CDR1 sequence GYTFTSYWMH (SEQ ID NO: 9); the VH CDR2 sequence AIYPGNSETG (SEQ ID NO: 10); the VH CDR3 sequence ENWDPGFAF (SEQ ID NO: 11); the VL CDR1 sequence SASSSVYYMY (SEQ ID NO: 12) or CRASSSVYYMY (SEQ ID NO: 13); the VL CDR2 sequence STSNLAS (SEQ ID NO: 14); and the VL CDR3 sequence QQRRNYPYT (SEQ ID NO: 15), wherein the MM comprises the amino acid sequence of SEQ ID NO: 309, wherein the CM comprises the amino acid sequence of SEQ ID NO: 688, wherein the MM is linked to the CM such that the activatable antibody in an uncleaved state comprises the structural arrangement from N-terminus to C-terminus as follows: MM-CM-AB or AB-CM-MM, and wherein the linker and the agent comprises vc-MMAE.

50. The conjugated activatable antibody of claim 49, wherein the conjugated activatable antibody comprises a first linking peptide (LP1) and a second linking peptide (LP2), and wherein the conjugated activatable antibody in the uncleaved state has the structural arrangement from N-terminus to C-terminus as follows: MM-LP1-CM-LP2-AB.

51. A conjugated activatable antibody that, in an activated state, specifically binds to human CD71 and cynomolgus CD71 comprising:

an antibody or an antigen binding fragment thereof (AB) that specifically binds human CD71 and cynomolgus monkey CD71;
a masking moiety (MM) coupled to the AB that inhibits the binding of the AB to CD71 when the activatable antibody is in an uncleaved state;
a cleavable moiety (CM) coupled to the AB, wherein the CM is a polypeptide that functions as a substrate for a protease; and
an agent conjugated to the AB via a linker,
wherein the AB comprises a heavy chain variable region comprising the amino acid sequence of SEQ ID NO: 5, and a light chain variable region comprising the amino acid sequence of SEQ ID NO: 7,
wherein the MM comprises the amino acid sequence of SEQ ID NO: 309,
wherein the CM comprises the amino acid sequence of SEQ ID NO: 688,
wherein the MM is linked to the CM such that the activatable antibody in an uncleaved state comprises the structural arrangement from N-terminus to C-terminus as follows: MM-CM-AB or AB-CM-MM, and
wherein the linker and the agent comprises vc-MMAE.

52. The conjugated activatable antibody of claim 51, wherein the conjugated activatable antibody comprises a first linking peptide (LP1) and a second linking peptide (LP2), and wherein the conjugated activatable antibody in the uncleaved state has the structural arrangement from N-terminus to C-terminus as follows: MM-LP1-CM-LP2-AB.

53. A conjugated activatable antibody that, in an activated state, specifically binds to human CD71 and cynomolgus CD71 comprising:
an antibody or an antigen binding fragment thereof (AB) that specifically binds human CD71 and cynomolgus monkey CD71;
a masking moiety (MM) coupled to the AB that inhibits the binding of the AB to CD71 when the activatable antibody is in an uncleaved state;
a cleavable moiety (CM) coupled to the AB, wherein the CM is a polypeptide that functions as a substrate for a protease; and
an agent conjugated to the AB via a linker,
wherein the activatable antibody comprises a heavy chain variable region comprising the amino acid sequence of SEQ ID NO: 5, and a light chain variable region comprising the amino acid sequence of SEQ ID NO: 825,
wherein the MM comprises the amino acid sequence of SEQ ID NO: 309,
wherein the CM comprises the amino acid sequence of SEQ ID NO: 688, and
wherein the linker and the agent comprises vc-MMAE.

54. The conjugated activatable antibody of claim 53, wherein the conjugated activatable antibody comprises a first linking peptide (LP1) and a second linking peptide (LP2), and wherein the conjugated activatable antibody in the uncleaved state has the structural arrangement from N-terminus to C-terminus as follows: MM-LP1-CM-LP2-AB.

55. A conjugated activatable antibody that, in an activated state, specifically binds to human CD71 and cynomolgus CD71 comprising:
an antibody (AB) that specifically binds human CD71 and cynomolgus monkey CD71;
a masking moiety (MM) coupled to the AB that inhibits the binding of the AB to CD71 when the activatable antibody is in an uncleaved state;
a cleavable moiety (CM) coupled to the AB, wherein the CM is a polypeptide that functions as a substrate for a protease; and
an agent conjugated to the AB via a linker,
wherein the activatable antibody comprises a heavy chain comprising the amino acid sequence of SEQ ID NO: 325, and a light chain comprising the amino acid sequence of SEQ ID NO: 701, and
wherein the MM comprises the amino acid sequence of SEQ ID NO: 309,
wherein the CM comprises the amino acid sequence of SEQ ID NO: 688, and
wherein the linker and the agent comprises vc-MMAE.

56. The conjugated activatable antibody of claim 55, wherein the conjugated activatable antibody comprises a first linking peptide (LP1) and a second linking peptide (LP2), and wherein the conjugated activatable antibody in the uncleaved state has the structural arrangement from N-terminus to C-terminus as follows: MM-LP1-CM-LP2-AB.

57. A conjugated activatable antibody that, in an activated state, specifically binds to human CD71 and cynomolgus CD71 comprising:
an antibody (AB) that specifically binds human CD71 and cynomolgus monkey CD71;
a masking moiety (MM) coupled to the AB that inhibits the binding of the AB to CD71 when the activatable antibody is in an uncleaved state;
a cleavable moiety (CM) coupled to the AB, wherein the CM is a polypeptide that functions as a substrate for a protease; and
an agent conjugated to the AB via a linker,
wherein the activatable antibody comprises a heavy chain comprising the amino acid sequence of SEQ ID NO: 325, and a light chain comprising the amino acid sequence of SEQ ID NO: 702, and
wherein the MM comprises the amino acid sequence of SEQ ID NO: 309,
wherein the CM comprises the amino acid sequence of SEQ ID NO: 688, and
wherein the linker and the agent comprises vc-MMAE.

58. The conjugated activatable antibody of claim 57, wherein the conjugated activatable antibody comprises a first linking peptide (LP1) and a second linking peptide (LP2), and wherein the conjugated activatable antibody in the uncleaved state has the structural arrangement from N-terminus to C-terminus as follows: MM-LP1-CM-LP2-AB.

* * * * *

UNITED STATES PATENT AND TRADEMARK OFFICE
CERTIFICATE OF CORRECTION

| | | |
|---|---|---|
| PATENT NO. | : 10,179,817 B2 | Page 1 of 1 |
| APPLICATION NO. | : 15/146294 | |
| DATED | : January 15, 2019 | |
| INVENTOR(S) | : Jason Gary Sagert et al. | |

It is certified that error appears in the above-identified patent and that said Letters Patent is hereby corrected as shown below:

In the Specification

At Column 7, Line number 66-67:
"CDR1 sequence comprising the amino acid sequence ASSSVYYMY (SEQ ID NO: 12)"
Should read:
-- CDR1 sequence comprising the amino acid sequence SASSSVYYMY (SEQ ID NO: 12) --

At Column 100, Table 13, Group D:
"YDSDRPS (516)"
Should read:
-- YDSDRPS (568) --

At Column 101, Table 13, Group E:
"(919)"
Should read:
-- (1038) --

At Column 172, Table A:
"TF240 TCSIDNYTSSKNC.M 255"
Should read:
-- TF240 TCSIDNYTSSKNCM 255 --

Signed and Sealed this
Twenty-ninth Day of October, 2019

Andrei Iancu
*Director of the United States Patent and Trademark Office*